United States Patent 11,602,550 (COMPOSITIONS COMPRISING BACTERIAL STRAINS AND USE THEREOF IN CONTROLLING PATHOGENIC MICROORGANISMS) - sequence listing, part 3

SEQ ID NO: 6 - DNA, 4096210 bp, Bacillus subtilis (residues 1-2,048,105 of 4,096,210)
tatcggaggattcggagaaggtaatccggtgtctctactctaactatggctggagcatacagtgcattcggaaataacggaacatataacgaaccgcattttgtgaaatcaatagaatttaatgacggcacgaagcttgacttaacaccgaaatcaaaatcagcaatgagcgattatacagccttcatgattacagatatgctgaaaacagctgttaagacaggtactggacagctcgcccaagttccgggagtggaagttgcaggtaaaacaggtacaacaaactttgatgaagcggatatgcaaaaatacaatatcgcacaaggcggtgtaccagattcatggtttgtaggatatacacctcaatataccgctgctgtttggacaggtgtagattctcaaaataagataggaaaaaaatctttaaataaaacagagcaacagattgccaagcgcatcttcgcccagctcattgccgatgtcgatgacggaagcggatcatttgagaagcctgacagcgtagtggaagccaccgtagaaaaaggttctaatccggcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattatgacggagatgcgacctttgctgttaagcaatctgttgacggcggcagctactcggaaattcaaaacagctctgcaaaagaggcagtcatttcgggtgtgcagccaggatctgtgtacaaattcgaggtaacagccgtcagtgatgatggcaaaagtacagcttccacatcttatgaggtgccaaaagctgaagacgatgaagataaaaaagaccagcaacaaacggatgatgaaaaacaagatgatgagaagactcaggatgatacacaactgatgatgatctcaaaaagatgacggtaagacggatcaagatcagacagatgattcaacaaatgatcaagacaaaaatcaagacaacacgaacaccaatccgtctgacaacagtaaccaagaccaatctaacaatagtaataacaataacagtaataaccaggatacgtcggatggtgattcgaactcagatacgaatgactcaacaggtactgacacgaataaaaataaacagacacatctaataaaacacaaacaaactcatcatcaattgaaaaaacaaattaaccaaaaagccgtcacctttggggtgatggcttttttggtacacaataaaaaacctcccgttttaacaggaggttttatcgattcatcgcatgatatttataaaaatgctttttcatttcggtaatcagctcatcaagctgaataaagcaatggtattgggtcggcttaagaagaataaattccactcgttcagcccaattaatcggctttgcgggatatgatttctccctcagttcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcctcccatggcaaatcgccttgtaattccgtgcagaaatcaaaatacacgggattggtctgcaaggttttcttcatatccgaggaactcttctggccaagactgcgcaagtattgctcataggaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggcaatggccggcacgccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagctacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcttgctccacagttttaagcccgtttttcttccattcaaacaaaatccggtcaatgtagcggaaactgagttttcctgatagtacagcctcttttaacgcgtgtttgatcagttgtgcgtcatgctgatcctggtcctgccagatcgccagcgtttcacactccaaaggcgataacggccttgcgaactcttcctcaaaaatggtataaaggcttttttgttcccttctgcttttctttcctgtgtttgattctgtgcaagctgaatatactcgtacagcttgccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtaagcagaagattggggatggttgatgttccctgctcctgcatatcaataaattgctgttttttcatcgtcacacctcttactgtaaaggattgtgattgcccctttactgtaaaaagtctcccttgcaggagactctttttgtttcatttgaatgtattacggatacagacggtttaacagtcttgggaacggaatcgtttcacgaacgtgaggcgctccgctgatccaagctactgtccgctctaatccaagccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtaattcttggaacggagctttgatttgctcaagttttgacgtgtctcttcccaatgtgtttagttcaattttgcaattttaagaactgattgcacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatatgcatcttcatcaaagtactttgtggcaaagagttctgttgttccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttctgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagtactttaacaaattcatctacatctttgaaaccgcaagattgagctgcctctattgcattcgggaacaagtaaaaagcaccttccggcttcacacagctgaaccctgggatttctatgagctttgcatagatcgtgtttaatctatgttcaaatgcttctctcatttcttccaatggctcagaaggcccgttataagcagcaatcgctccgtactgtgcgattgatgtcgggtttgacgtactgtggcttgcaaggttcgtcatcgctttaataatgtcttcagagcctgccgcataaccgattctccagcctgtcatgctgtgggacttcgatacgccgtttataatgaccgtttgttctttcagtctgtctgacagctgtgcaatggaaacatgtttctttccgccgtatgtaagtttttcataaatttcatctgacacaatcaagatatcatgttcaaggcacacttcaccgagtgcagatagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccggatagcttacccagtaaggcgttggaataataacttcatcttcttcatccaaaatcacttgaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggttctcctgctcctaagccgatgacatcatggcctgcggctttcagttctttcgctttcgctgtgattgccagtgtggttgatggtgttaatgcggatactctttttgccagtttcaacttgaactcccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataatgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagcgcaaggccgaacatcagattgtctcttttcagtgtacgattcaatgtgtccacaattttatacagatcatcagaatgctctacattaattgttgaaagaatttcgattttactttccattttttcatcctccagtttgaacaaatattgttagtcatactccatttcaggacacgccatactagtatcacagagcgggaaatccgcttttaaataaaacaccatcctactcccacaccgcaaaagccgctttatgcggcttttattctttttccctgcaacataagcttcaagctcgctgtcagtcatttcggatactgaggttgtcggcaaggcatcaagaaacagccggccgtaaccagcggttttaatccgtctgtccaatatcataatcgttcccttgtctcccgcagaacgcagcaagcgtccgattccttgcctgaaggtcagcacagcttccggtaatgacactgtttgaaacggattctttccttttttgcgggcaagctcacattttgcagcatgaagcgggtgatcaggggaccggaatgggagcctcacgatcattactgtcgtcagctcatcaccagggaaatcaacgccttcccaaaaatgatttgttccgagcaggatcgcctgattggatgttttaaaagtcttcatgagtttgccgggacttccgcctgtaatcccttgtgccaagagctgaatgccggaagcactcatgttatgcttaagctcctggtgaacctttttcagcatatcatgggatgtaaacagcacaaggattttaggctgtttttcctttgccatcagttcgatataacgggctgtatcctgtataaattcaggttgccctgtatcctgaattgatttcatttcctttggaatcatcacctgcatacgctcatcgtaagaaaagggtgactcaattctcattgtccgcggaaaaagtcactcagtcccagtcgttcaatcataaattgaaaagaaccttcgactgtaagagttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcgtcatcagacccaaagaagagcttctgcaacgtctgacagtaatgctgcaagcctttcatgcttctttggtattcatcggctaaaaagacggttttgctcttcatacccttcaaatgtttttccatcagggatgactgcgcctcaaaaagctgctgcaaatgtgtcagcatggaacaaagcctctccgcaccatccgttaagatcgaccagcttttatcctggctttctttgttcaccttaaacactagacggtttaagtcttctttaggttttcttcgtttgacaaaagaatgtacagagctaaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtagctcttttccctaaatgttcgcttgccgcacgttcaaaatggtgtgcttcatcaataataaatgtgccgctttcgggaagcctttttttctggctggcttcatcggtcagcaaaagggaatgattggtgatcaccaaatcggagcgcatagcaatctgtttggctcgctcgtaaaacccgatcacatgctcactgcgacttcttttataggagtcatcgtcataagccaatctgtcccacagcaattttccgcctgaaggcaaattcagttccgctacatctcctgtatttgtctctgtcagccaaacgagaagctgtgcctttgtcagtacagcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaatgcatcagccacctctctcatcatcatcatttggccgtctcttttttcatacccaggcattaactctgacagcgctttttcatttcccgcttcccagctttcgatctcaaatgagaagttctcgtcctcatttatacgagcatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatgcgtgagagctcgacagtatcaagcacttcacaatctgggagctgaaagcccgccttatgtagctcatacttgacaaatccaaggtcaaaatggatattgtgagcgacaaaataagcgccgtcaagcaattggaatacttcttcagcaactgcttcaaatggctgttcattttctaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaaccccgataagggggcttttcttctacaaaattgtacgggctggttcgtttcccagcatttgttcaattttgttttgatcattcagaacagccactttcggctcgtggcttgccgcttcttgatcagacatcattttgtaggaaataataatgaccttatctccttcctgcacaaggcgtgcggctgcaccgtttaagcatatgacaccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagcttgccgctcatcattgttcgatacatattatattctctccatttctcgaatatcaataatgatattatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagttccgcacttgtttgaagggcccgatacagcttaggcgcttcttttctttcctcagctgttaagtatacattgcgagagcttttggctaagccgtcttcctctctgaccgtatcgacaggaaccaatttaatatccatgaagaagtcactgattaacccatcaacaacagctacctgctgcgcatcttttaaaccgaaataggcacgagtcggcttgactagattgaaaagcttcgtcagtacgatcgcgaccccgtcaaaatgtccttctcttgagcgcccgcataacacgtctgtgcgtctttctacatgaatcgtgacattcttttcaccgggatacatatcatgagcatctggcgtaaataaaatatcgactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatggtattgttttatggcttctttcagctgtgaaatatcagtaatctgtctcatcttattttcccccgtacaagccgtcaagcactgtctggttcatttgaaaggaatgcttttgttcagggaaagcacgatgtcttacatcctgaacatatccgctgattgctgtttcgatggtttcatcaatgcgcatatattgctttacaaatttaggtgttctctcaacaccgtggccgataatatcatgataaacgagaacttgtccgtccgctttcacaccagccccgattccaatgaccggtatgcttagcgtctcggcaattttggctgtgagttctgccggcacacattccagcacaagcatcatagctcctgcttcttcgcattttatactgtcttctattaatttttttgcgctttgttcgtctttgccctgtactttatagccgcccagtacgccgactgactgcggtgtcaaacctaagtgactgactactggaatgcctccaagcgtcaatgcgcgaatggattcaaacacgccttctccgccctcaagcttcagtgcgtcagctccgctttcctgaacgatagccgctgcatttttcagcgtatcttccttagacaggtgataagacataaacggcatatctgtcacaataaaggtattcggcgcacccctttaacggcttttgtatgatggatcatgtccgcaactgtcacaccgacagttgaatcaaggccgaggacgaccattccaagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgttttcttctgcaagccaaaaaaccttccgttacaacgagaaggattcttcactttctaaagttcggcgagtttcatccctctgtcccagtccttttttggatcaaggcagactgctgcaatgtctatctattttaataataggtgcagttcgcaggcgatactgcccaatggaagtataccaaaatcaacgggcttgtaccaacacattagcccaattcgatatcggcagaatagatttttttaatgccttcgttcgtttctaaaagcagaacgccttcatcatctatacctaacgccttaccgtaaaaggttccgtttaacgttctggctctcatattagtgccaataccgagcgcatagctttcccataaaagcttaatcggcgtaaatccgtgcgtcatataatcccggtaccgtttctcaaagcatagtaaaatatgctgaatgacgccggcccgatcaattttttccccagcagcttggctgaggcttgtcgcgatgtccttcaattcatctggaaaatcattaggctgctggttaacgttaatgccgatcccaatgatcactgaacgtacgcggtcttcttcagcctgcatttccgttaggataccgactgttttttttccgttaatcaaaatatcatttggccatttaatatccgtttggatgcctgctgcctcttctattccctgcacaacagctactgcagcaagcagagtcagctgcggtgttttttggagcggaatgtcaggccgcaaaatcaggctcatccaaacgccgtttccttcttgagaatgccaaaccctagacattcggccccttccggctgtttgtttgtcagccaccacgagggtgccttccggtgcgttattattcgcgagctcatgagccgttttttgcgtgcttgaaagaacgtcatagtaaataagatgctggcccatcacttccgttttaatccaaaacgaatttcgctttcactgagttttccaggctttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaataaggtcttttcttaatgttgaccgcatgtcttcagccactcctctatgtgtttcttttgattggagagcttccctgtcacaacagcctgctcgatccgctgtaattcttccgacacccattttccagccggtcgtttcgaagcgcaagcaagtccttacccgtgatatcaagatccttaaggcttttgatcggcaggttttgataagcgtactgaatgtccttcagtttcttttcatccagtttttcgttttgccgaagctgcgatattttggccgcagagagcagtgctttttccccagctctgtacattgtcattacgtcaaggctctggccaaacgtatcagcaatgtgaatggcttccttgatcgcttttcccgggagcttccaggctttcaggaaaaggggcgcgtctttcaagactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagcgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaaacgtacggctctcagcatacgaagcgcatcctcttgaaatctatcctcaggctttccaacggttcgaatcactttctgatcaatatctttcttgccgccaaaataatcaagcaccttccgtccgctgtcatggccatcgcattgatcgttaaatctcttcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagttcgctgaaacagccgttctacttgatcaggtgccgcatctgttgcgatatcgacatctccgatcgttcgtttcatatagctgtcacgaactgcgcccccgacaaaataagcctgatggcccgcttcgattaagatgcggagcacgggaagtgctttgataaaaactttttccatgtgatcactccggttctgctaaatctgcataaatctgttcatactggctgacaattttttgggaagaaaattcattttcaagcatctctattgccgcctttgtaaaacgattgcttagctgttcatcttctaaaatgctcatcgcgcgggctgttgcggccgcaacatcaccgacatccaccaaaaatccgctcacattgtttttaataacctcagggataccgccaatgtttgttccgatacaaggcactccgcaagccatcgcttcaagcaggacaagaccgaagctttctttttcagatagcagcagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacctttctaaagttggacacatggatgacgactttttcatctggtaaaattccatgtttctctttaatcaccgctgtgtttttcttcagatacacgcgctcgtctataaagttataaatcgtttcaatttttttctccggtttaattaaatcgtacgtttcagccgcaagcgctgaggagactgcagtcaccctgtctgatgactcaatagcaaaacggatcagatcttttagagacggatcataacctaacaccgtgatatccgtgccatgcaaagttgtaacaatgccgatattgcgtttcagcatttgttttgcaagataggcgcatacggcatgcggaagagcatagtgagcatggataatgtctaaattctcccgttccgccacctctgcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacccgagcctccaacgctcggatagcatgtgattcctatttttagttttctcattgttcgcccccaagcacatcatgatcaagcatcagcatccgtttggaaaagaaaccttcggcatactccacgcccgcttctttaccgtaaagcttttctctcgcttcaacgatctcgatataaccattcgtcagaggagtagaaactgaatcctttgacgggataaactggcttttgtaggcgttgaggctttgttcctttgcctctattgtatccgagatatcaatgacaaaatccggctgatgaaaaccatttatcatataatagtaaaccttgctgactttatgcgccggaaggcttttttcatctttatatttatggattccggcggaaaagatcgcttcttccaccagtgcagccgcattgccgtgatccggatggcgatcctttttatacggcataaaaaccgcttttgggcggcaggttctgatgacagtgacaatcgaccggattgcctgatcactcattattaggccgcggtctggaagcgtcagctgaattcttttatctgcgcctaatatgcgggctgcttcagctgcttcttctttacgtaaactgaccgtaccgttagaagagagttccgcttctgtcaagtcgcatatcattactttttttccctgtttgacaaacttcgctattgtgccgcccattccgatctcgacatcatcactgtgggcgccaaaagcaagaacgtcagcattatacattcggctcttctcctcgaagaaggtcacggaattcgaaaacaccttcatcaagtgtgcggacgagaatttccgcagtacccatatttgtggcgagcggaatggaatacacatcacataaccggattaatgccgagacatccggttcatgcggctgcgcggtcagcgggtcgcgcaaaaaaatgacaagatcgagtgcattggcagcgatcaatgcaccgatttgctggtctccccctaaagggccggattgaaaacgttcaatttgaagacctgtcgcctcttgaattttcaaccctgtggttccggttgcgtataaatcatgattctttaaaatatcccgataggcagtcgtaaattgaaccatgtcctgttttttcttgtcatgcgcgatcaaagcaattttcattgtttatcccccgtctaatcaatgatattttctaaaccgtacacaagctgatcaatcttcatgacttgttcgactgacagtttaacgcctgacatgaaagaagcacggttataagaatcatggcgtatctgaagcgtttggccatccatgccgaacatgacctcctgatgcgcgatcagtcccggaagacggacgctgtgcaagcgaatgccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagacgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaagcaggcatggatatctgtgtaaattaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatcttgatctcctctactttccttcttcttttctggtccagcgatctttatctcttgtattaaatttatgcatgactcggtcgtgagcttcctctaaagagatatcaagagagttggctaaacaaaccaatacaaatagcacatcgcccatttcctcttccatgcttttatcatcttcagtcgctttttttggtttttctccataacggtgattcacttctctggcaagctcgcccagttcttcagtcagcctcgccatcatggccagcgggctaaaatatccttctttaaattggccgatgtaacggtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggtttgtgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatctcgaacctggtgttgaacattccgattttttttattggctggcgtttgctcggcaggacaatgtttgtttatacccttgtcggcactgtagccttgtctttgttcctcagcatctttcagcgatatgaaatacatatgccccttcagcacgacttagcgctcgccgctttatttgccggcgtattcatcggagccggactgggtattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcctcgaaaaacgacctgattcagaaaaagattcttgaagaaatggaacgtggcgtcactattttgaaaggacaaggttcctacacaaaagaggatatagatgtactttattgtgtggtgccgaaaaacgaattggtgatgctaaaaagcgtgattaactccattgatgcccatgcctttgtagcggtaagcgatgttcacgatgtgctcggagaaggatttacgcttgatgaaaataaaaatccgcttccgcgctgacatgtaatagaaaaaaggcggctgaccgccgcccctcatccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcttgctgaagaagggaaagccgttcaagcttcgtgctctctgtcatttgctgaaactcctcttgctcaataacatctatatgttttccgactgtttcaagctgatcctctgatacatcgattgtaagactggggtaaatcaagtcatataaactgataaattcattccatttttcatgaaagcttgtgcttccattcttttggacatctcgcttcagctcagtaaaagcttccataattggtttttccagtgaaccccaaagcgggtcagaccgattgtcaaccgcatccatcagcattctgaactgcgcggctgctctgagtttttgtgtgtctgatgtatcagcttgctttaaactccgaaccatatcattatagcccaatgtgatttgacggatttgggctcccgttagcatggggtcttgctgttttttctcagcggattttaatgttttttcaaaatactccaagacttgaagcgcctcttcatatttcgcctgtcgggtcatttgaaagactgtatcggataaatcattcaattcctcgaggcttcccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgctttttcgagaccacaagaaagtaagcaagcccgattgaaaagatgcttagccaaaatgttccgtatcctatttcagtcatataatcagaaagcatagagtattgcggcatcatatcaaacaagtagtcaatgacatcgttatgcagtgtccagactgcagcaattgcaagatgccaaaatgaaaaacgaaaatacggactgtataatacgccttgaactgccattgcaaaatgcgaagcaattagcatgtagccctcccacggcaagtcaccagttactgcaagcacaagaaaattcatagccaccgcccataggccatactttacgagggtaactagcgcaagcgcctcaaagagcggagcattccgtttcatgagaaaggcaagcagcacaaacagaaagaaaaacgttgctgtcggactgtccggaacaaaaatcaggaaacgggccggtgtctccaaaagctgcggcaagtaccaatagtagccgtaaaccgttcccagaaaattaatggctaagacaagaataagtatcggccgctgccctaatacatattgaaaccatttcacatcgaatcaactctcagtctgtaaaaataatatgtccatataaaaaagctgacgccgggtcagcttttgataataaaagtatatccttccatttgacaattcacaatacgttattttgcggttgtttcagaaataaattttgcaagttcttcgagctgcttatcatttcctttgaacacacccgccggcattttgccttttccttctacagcgatttttttgatttcttccggtttcagcccgctgtcaaccaatgaaggcccagccgctcctccctgaaggttatccccatggcaagaaatacagccctgttccttaaagaccttatatccttctgcattggtgtcaatgtcggcttcttttgtgattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccagcggcgtattcatacttcaacagctggtataagaaaagaaaataccaatccggcagcggaatataaccagtatcagtcgggtccgccatccgctccaaaggcggctgatgcacaatcgtcaaaacgagaaaaccgatgagaaagacagctccaaccatccattcctttaacaagaaatttggccagaaagcctctgttttaccgggatactccgaataatccttcggtatattcggctttttttcagccggtatccttgagtcgcctacaaatttcatccctttgccccggtgcatgtcatcccctcccttttattcgcagatcaagagtttaaagcggtcctgaaattccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacctgcgttccgatcaaaggcgtggcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcgccttggaaaaagaccctcagcgtatgtaaaaacatcatcacaatgaccaggctcgcaccccagtggtgcatccccctgacaatctggccgaatgctacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacgcctgtgagcgtgtaattcaaaaattgacgtctggatatatcatgttttccgcccatctcttctcccccctctaggtacccctgcaaactaactaaaatagaaaatattgcaataactctagacaccctcataatatatgaatctctcagcaaggtcaatatagccaaaatattgtttataaggaaatgtaagtgtttttatgaagtgctccataactgtaacaaaacgttcaaaatttcagcagtgcgttcatccaatatttttctttttaaagagtcatttaaatgctctaatggaacagacggtgtaacaatgattttgcctaacgcatcctcagctctccaactttcgtcagatgtgagcaggacaacatgcggaaattccgttatcagctcttcccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggcatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcgtcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagccgaacggaaattaagctggataaacaaatcctgctgtttatttaatctaatatcatgaaaagatttttccgcgtcggtagtcatgacattctctttatagaaccggaacggaacttcttcaacacaatgtgttgacattataatgcctctcgggcaaaattcagcctgctccacaaaatgaaccttctccatgagagaatcatggctcattaagtagttcaagatccaaacgcactctcggcgctttaactgataatggtttaaaaaccaacggataaaatcttttttctcattgacagaaacaggggtctgcatgtaattccctcctctatcgttcgtataatctatatacttatatgttccacatgaatggttaatattcctgcttatctagaaaattcatcctcgattcgcaaaatcgtttcttcaagctcttcattggctccgtccatttcaagaacctttttcaaaagcggcagcgcttctttttgaaggccttcttctaataggaagcttgcgtattcatataagaaatctctatcctcccggtaatgaagataggcagcctcaaaggattgttttgcttcctcgtattgctctaattcagtatatgcgcttgcaagataccaattgtatttaggatcttcttcaccgtagcttcgaacctcttgaataagatcaatgatctgatcataatcctcttctttgtgatacacggcaagaagtgtatgaagggcctcgacaaagcccggatcaagcgcaagcgcctcctgaagcagcttcttcccctcttctgacttcccgatttttaaggccattttggcggcataaaggaaaagttctttgttatattcatcatatctgatcccctcttttgccgtttttaatgcctcttcatacattccttcagcttcatagcttttcgagagcggcatataaagtgaagtataagatggatcaagctcctttaaatcagacagctgcttaatagctgttttcacaagccccgcctgtaaggctgtaaaaccatagccgaaaatcgtattaggatcaggattctcatcgacagctttctcataccatggaatggcatcctcaaattcacctgaggcacttaacgattctgccagtctttgatggacattaacgcccccgatctcactctgctcctcagccgttgttttaaaatattgaaccgcttttgcataggctccctgagcaaagtaaagttctcccagtgcaaaatcaataacaggttcattgtccagaatggactttgcctggaaaagcttttgttcactgacttcgaataacccctgcatctgataaagatccgccataagcagcaaactttccggatatgatggatctgtttccggaatagtctccagcacagcgagggctttttcttcttcgtcaatatctattaaaagttcagcgtagaaattcgtcagttctgtttcatttggatataaatcatgtagatcactaatcagtgaaatggctttttctacatcgccccactcgtaataaagctgggctgcaatggctttatcttcatcatgcagctgtttttcagccttcgagagcgtgttgaggcctttttctgtttcacctgcttcaactaattttatggcttcttgaatcaatgtattcaaatcggaccggtcctttcttttcctatacaacatcaaccatacaaaaaagctttatttgttcgggttaatcttatcataattcagacgaatgcccccgcaaataagatgcttctgtacggaagggaattattgagtcttattagtttaccaaaagatcttgagatagaaaatgaaaaaaggaagatcgccctctgtacagtaaagcagctctttgacctgccggcttgtaagtaaagcacatccccccttttcgtttttctatccgttctataagacaagctatgttttttcgcctcgaattatgatctgcataaaaaatcctgaagtaaaacttcaggattttttcgaaagcttatttaaatgctcgaagaaggttggataagaaacgtgaatggcatccgtgtgctcgatttcaatcggctcctccgttatacaggaagcaataccaagcatcattccgattcgatgatctccgcggctggacactgcagcgccgcctttcaacgtttgtttgccataaaccttcattccatctgctgtcggttcaatttcagcacccagcttgcgaagctcagaaacaacagtatcaatacggtttgtttctttcacttttagctctgccgcgtccttaataacggtggttccttccgcctgagtcgcaagaagcgcgatgatagggatctcatcaattaaacgcggaatgatatctcctccgatttcaactgcctttagagatgacgtttctataatcaaatctccataaggctctgcaccgctatcagcagatggtttgatttcaagttttgcccccatgttttgaaggacatcaataatacctgtccgagtcggatttaaacctacgtttttcaatacaattctgctgtttggaaccatcgcgccagcagcaaggaaaaacgcggctgaagaaatgtctccaggaacaaaaatatcagcagctgtcagtttctggccaccagcaatggaaacactcgtttgatcttcagaaagcttaacgccaaaagcagaaagcatccgctcagtgtggtcccgagatttatggggctctgttacagttgttgtgccctcagcctgtaatccggccagcaaaacagcagatttaatttgcgcgcttgcaacaggtgatacataatcaattccttttaatgaagcgccgctcactgacagcggtgtaaactctccgccggctctgccgtcgattttagcccccatttttttcaaaggctcagtcacacgcttcattgggcgcttcgcaatgctctcatctccggctaccgcgctgtaaaaaggacggcccgccaatattccgagcatcaggcgaatcgttgtacctgaatttccgacatctaaaaggctttctggctctttcagggcatcgattccttttccgtgaatcacgacatcgctgctgctttgctcaatgtgaacacccatttttctaaagcaatcgatcgtgctcagacaatctgctcccggcagaaagtttttaactgttgttgtgcctgccgctagcgcgccaaacataacagagcggtgagaaatggatttatcaccgggaatatgtatttctccatgtaaggtctgcaccttttctcgtttcattttttccacctcaatcagcataaaaagtttcatattccgcccgggcttcaatgcattgttctgcccttttgcggtcgtcatcagactgaaaactgatccttaaaatcccgttaatatcctctcgtgtttcgataatgcggatattcgtgatactgatgcgctccgcagctaagatcgctgttatctcggatattacacccggatgatcgggtacatccacatataaatcataaaatgcaggtatcgctcccttctgccgaagcggcagcccgtcgcgataatccttggctgttttaaaataacgaaatagattttccgcatcttcttgttctacatatgtacggatcttgtcaatttcacgaatccactcatcaaaacggtctaagattttatctttattatgtaataaaatatcccgccacattgccgggctgcttgatgcaatccttgtaatatctctgaacccgccggcagcaaaacgcttaacaagcggatacaggttttccgaatgatgggtttggtgaacaaggctagctgctacaatatgcggaaaatgactgattacgcttgtaacgccatcatgctcctctggcgacatttccacaaaatgggcattcgtccccttcagcaggttttttaactgttccacagcttgtttgtccgttttctggcctggcgttaaaatataaaatgcattttcaaacaggaactccttcgcagcggccactcctgatttatgtgaacccgccatcggatgccctccgacaaattgatagcggctaggcaacacttgatcagcgtaatcaaccactttttgctttgtgcttcctacatccgtaatcaaaagctcatgttcaattcctgaatgagccagctcttcaagcataaccagtgtttgttcaacaggtgtcgcaatgattactgtagctgcctctttcacaccgctaataaacgaatcagcacgatcgtctatcacgcctaattttaatgccgctaccgcctgttcatcagagatgtcgattccgataatccgtttgccgggatgattttttttgatggctagggcaatcgaaccgcctatcaatccgagaccggcgagcaatattgtatctttcatttgattcatacgtcatcacctggtttatagactaaagaggtgatatttgatcacctcttataaaatttcagctaaaatggcaagtatttcttcattttgctcttttgttccgatcgtaatccggagtgatgtcgggaaacctaatgcgtttcctgaccggacgatatagcctttttccagcagagcctgaaacagttcatcagcaggacgtttaaagtcaattaacacaaaatttgtctgtgaagggtagcactttaaaccatgagttttcgcaaaatcataatactgctgaaggcctgcattattttgctcgacacaggaagcaataaacgcttgatcatcaagtgctgcaatcgccgcagcctggcccagacggctggtattaaacggctctctcgccggctcaatctggcgaatcaggttctcgtcagcaattccgtatccgactctgagcgctgccagaccgtatgcctttgaaaatgtgcgcaaaatcatcaaattggaatacttgcttaagagcggcacggtttccgggtaatcctctgctgttacatattcataatatgcttcgtcaagaacgacaaggacacgagaaggaacgcgctccagaaatgcgagtaattctccttcagatgtataagtgccagtcggattattcgggctgcatatccaaacgacttgtgtctgttcgtcgatggcttctaacatggcgtctaaatcatgtgagccgtcgggacgaagtgcaatttcacgtacttcagcaccttcaataaccgcattatgtttatattgcggaaaagtgggggcagcagtaaccgtgtttgttttatcgtttaaaaatgcccggcagatgatctgtatgatttcatcagaaccgttgccgaaaataagtgatgtttcgctgacattgaggtgcttactgagccttgtccgcaaagcggcgctatacccgtccgggtaaagggctagctgttgaatctcatgatgaagcgcctcttttgcagcctctgaacagccgtaaggattctcgtttgaagcaagcttcacaactttatccaagccatattctgatttcactgcttcaatcggctttccaggctgataaggcttcagctgttttaaatgttctttgatacgcaaatcagtcacctcattttaaactgtacaagccgccaaacgccattgcataatcctcaaactcctgcagcgcctgatttctcgtttcagcgctgatgagccggtcctttaattcttctatttttctgacgagcgcgcttcccactacgacaccgtcactaatctcattcatctttatgacctgttcacggtttgatataccgaaccctacggcgaccggaacagtgctgagattcttcactgtccgaatgaacgggtacacggatgaattgaactcattgcggacaccggtcacacccagagaagacacacagtagacgaagccctcggcttgttcaataatggttttcaaacggctttcgcttgtcggcgcaaccaaagaaatatacgtcacctcatggcttttacattcctcttgaaggctgttgctttcttctagtggcagatccggaacaagcagaccgtcaatatgattttcccgcagtaaagcgaaaaagtattctttgttcaattgtaacacaggattataatacgtaaagaggataatcggaatattcactccgttttttttcatttctccgcctaattcgattgcctttacgatattcattccttgatcaagtgcccgctttgaagcccgctggatcaccggaccgtctgcaagcgggtcagagtatgcaacaccaagctccaatgcagtggcgcctgctttttggagtgacttcgccagttcaatcgaaacctcaggaactggatcgcccgccgtaataaacgggataaacaatttttctgatggttgaagatccaatttaaacatgggctttcacctcttcttccaataccttcattaatgtgttgacatccttgtctccccgtcctgataaacagacgagaatgagttgaccgcgatccattcctttggcgagtttgaatgctttcgctaacgcatgggcagattcgattgccggcaaaatcccctctttttctgacaaaagctttaatgcatccaccgcttcttcatcagtgatactgtcataagtgacacggccgctcttatgcaagtatgcgtgctccggaccgattccaggatagtcgagaccggctgaaatagagtagggctcaataatttgcccgaattcatcctgaatgagataagtcaatgaaccgtgaataacccctacggttcctttcgaaatagtggcggcatgaagaggcgtatcaattccttttcctgctgcttcagcgccgatcagttcaacatcttcatttaaaaatgcctgaaacatacctatcgcattgcttcctccgcctacacatgccactactttatcaggcagagtgccttcaatacgtttcaactggtccttcgcttcctctccgatcattttttgaaattcacggaccacttgcggataaggatgcgggccgacaactgatccaatcatataaaagtgatcctcacaatgctgaacccagtaccggatcgcctcatttgtggcatccttcaatgttccgtttccacttgttacaggcactacctccgctccaagaagcttcatgcggaaaacgttcagagactggcgggcaacatcctcttcacccataaacactgtacaggaaaagccgaatttggctgcaactgttgcagcggctacgccatgctggccggcaccggtttcagcaatgattttcgttttgcccatttttttagcaagcagcgcttgacctagcgcattattgattttatgagaacctgtatggtttaaatcttctcgtttcaaatagattttcgcgccgcctaagtattcagtgactcgatcagcgtatgttaatgcagtcggccgtccggaatagtcctttaacagcttataatactcttcacgaaaagcgggatcatccttgatttgtttaaatgctgtttctatttcatctaacggctgcatgagtgtttccggaacaaactttcctccaaaatcaccgtatctgcctatttcattcggatatggatacatatcggttcatcctttcttctaaaagcctcatcagattctgatctttttgtccgtttttttcaattccgctggcaaggtcaattccttctggctgccatttcaataggcctgtgatgctatccggattcacgccgccagcgataaagcagcgtttaccaatagccgcctgctgatattccggcacacattcccaagaaaatgcaacaccagttccgcctctagacccttttacagacgaatcgatcacaaagccgtcaacatgatctttaaagcgggctatttcttgagttgtgttatcctgatggtgaagcgccttccatatttcacagccagtcagcttgcaaagagcatcagcatccgccggtttttcatcaccgtgaagctgaatgacgtcgagcttcaagctcttggcaatacgtgacatcgtctctattgattcattaacaaaaacacctgcaacctgtttttcgacccgaacttggttcagccattttttcacatcttccggagatacttttcgtttgctttcagcaaaaataaatcctaggtaatcagcctgtgattccgccgcaagctgcaaatcctttagtgaccgaataccgcaatattttaatgccggtttcttcacaacctcactccccaaacaaagcatggattgctttacgctgagaagtttgtctcatcaatgattcaccgataagtacagctcgcgccccatgttcattgacaaatgttaaatgttctaaagaaccgattccgctttcgctgacaagcaaggattctttcggaacgagagatgcgatttgttctgtctgctttacagatgtttcaaacgtttttaggtttcgattgtttacgccgagaatgtcgggtgtgaacactttcaatatttgttctagcgttgatgcatcatgaacctccactaacacgtccatccccttttcacctgcttcaagatataattcatgaaggtgtaagggatcaagcacctcgccgattaacaatatggcatccgctccgattcttcttgattcctctacttgaagagaatcaatgataaaatcttttctaagtacaggaatcgaaacagcacgctttacgtctgataaatagctgttttccccttgaaaaaacggggtgtctgttaaaacggaaatcgcatctgccttcgcagcttcatagtcttttgcaatctgaacaggcacaaaatcctctttaataagcccttttgacggcgatgctttcttcacttcggcaatcaacccaataaaccgattcgggcttgccagcgcctccttaaatgaacgtttctcgaaaggctgctctaccggcaaaaccagtgttttcacttcttctttcttttgtttgatgattttttcaagcatagatctcttcctctttctgctttagtcgttcaagctgcgcggcagcgcctccgcttgtaatcgtctctaacgccagctccgttccttccttcagtgaggcggtaattcccgccgtgtaaatcgcagctcccgcattaaaagccgtaatagataaagcggaactgctgcttttattttcaaaaatattctgaatgagataggcgctctctttcggtgactgcacctgtaaatcttcaagtctgccatttgtgaaaccgaaatcttcgggtgaaacggtatattcccggcgctctccgtcctttaattcaatcacatcggtcggtgctgtaattgaaagctcatctaaaccgtcacggcttgatacaaacatgacgtgcttcggctgaaacgtctccagtgcgcttgccatcagtccagctttttcaacagaatagaccccaatcacctgacgcttcgcctgtaaaggattgctgagcggcccaagcagattaaataccgttctgaaacctagctcttttctagtacctgctacatgtttcatagacgaatagtaaagcggcgcaaaaagaaatcccatgttgtttgtttcaatgctgcttttgaccttttcgggagtggtttgaatagaaacctctagctcctctaaaacatcagcgcttccgcttttagaagagacagagcgattgccatgcttagcgattttcgcgccagctgccgaggcaacaattgccgaggccgttgagatattaaaagtggaaataccgtctccccctgttccgcatgtatcaacaatatcaggaagtccatcgactgtaagagcgtgtgcccgcattgccttcacaaaacccgcaagctcttctggcgtctccccccgatgagcaagaattgacaatataccacccatttccgaaggagtcatttccgctgccatcatcatattcatcagcgtttcagcctcaccggcagtaagggtttttccgtcaacgcacaattgtagaaatctgttcatcagctttatcctccttgctatgaaacatgtcttctgcaatatgaatcgttttcagcagcgcaccggctttattacagctttcttcgtattcggcttccggaacagaatcagcaacaatgccagcacctgcctgtatcgatgcaacgccgttctttacactcatcgtgcgaatcgtaatgcaagagtcgatattcccgtcaaatccaatgtaggcaatacatcctccgtatgtctctctcggtgttggctcgagctcttgcaaaagctgcatggcacggattttgggtgcgcctgttaaagtccccgccgggaaagcagacatcagtgcatcgacaggatgaaccccttttttcaatcggcctgtaaccaccgagataatgtgcatgacatgtgaaaaggaaacaatttttgtgaactccggcacagaaactgaaccatactctgctactctgccgatatcgtttcgggcaagatcaacgagcatgtaatgctccgctttttctttttcatccttcatgagctcaaccttcagtctctcatcttcagctttgtctgcaccgcgttttctcgtaccggcaatcggatggatttctaagtgcccgtcttgaacgtgtattaaccgttccggagagctgccgactatttctctgtctagcagtttcatataatacatatacggcgaaggattgacgatcctaagcactcggtataactcaaaagcatctgcttttatcggcacctcaaatttttgtgataaaacaccctggaagatatcgcctgcttttatatagcttttgattttttctacatcagccataaaagccgatttttcataattagaagataccgtctcaaagctgggtgtcttgtatgaatcagcagagagaaacagctcttttatgtttttttggtccatcattttttcgatgagattttggagctccagatgattttgatggaatacatccattttttcgttttctgtttcctctccagtgagccttgcatattggataaagtggacgtttttggtttcatgatcatacgcaattaatgtccggcaaacaaacagcatgcacttttccatgtctgtttcttttctatgcgaaggaacagaaggctcaatcagcgggatcatatcatagcttaagtacccgacagctccgccgacaaaaggaatgccaagctgaggtgttttgattttgtatgtggtattcatccagttcagcacttcttttagttcatttcctgtgtaaagagatttgctgtcctgatcagcggccgaaaaacggccctgctcttctttaattgtgagaaatggattcaggccgataaacgaatatcttgaccaagtggatgtatcgtccttgctttcaagaagatacgtaatctccctgtcaagcttctctatcatttgaatgggtgtcagtgtatcgactgtgaaggtctccacaatcggtatcgtgtggtgggacaagctgtcctctaaaaatgcggaaatgtttgattggaaattcattgctctcactccttatggcaaggagaatgagaagatggcatgagaggataaaatactatataacaaataaacccaaaagaaagacttcttttgggtagaataaacatacatgtctcagctcaactaaactcattctctgctaccctattctctaactcaactcattctaatcgctttatacacactcttgtgtatttctaagctattcttatcgtattacaattcagtattttttgtcaatgataaatcgggcctcaatacgacggctttttctaaatatacatgtctgatctgatcctgagggacatctgtctggaccgtcatcatgactcttatgcactttttcagaccgcccgttacgtccatttcctgcatacatgttaccggtacatactgccatcctgaaagctcgcgaacagcttttgccgggaaaacagcgtgcaagtcaggtgtagccgaaagaagcatttgaacaacatcttccggttttgtatgattttcttctatgattttctctaacagctgttttgttttttgtaaaatttcttcttcagtatcccgttcaactgtagttgctccgcgaattccgcgaatcatcatgatgtctcctccaatcgccatttgttcagccagctctcaagttcatttctggaaaatgtatgatcagcaactttccctaattcgttgagcacaataaactgaatcttcccgccacgggttttcttatcattcatcatacggtccaagagaaccgaagtttccgtctcttttctgatttgacttggataacccaggctttttagccagctgaccaaacgttttctgtccatttcacagcctacagtcttttcgcttatatataaagcaaactgcattccgagggctacggcatcaccgtgagtgatctgcccgtatccatattccgcctcaacggcatgaccgagcgtatgcccaaagtttaagtaagctcttatcccctcttctttttcatcctgctgaacgacagacgctttaattgaaatgcctttaaaaatcatgtcattcagctgatcattagtgatatcacgcagtgagtggatattcagcagctcctccagaaacgctctgtcatagataaaagcgtgtttaatcacttctgccattccggacctaagctctttttcaggcagagaacgcaggaaatctgtatcatagagcacggctttcggctgataaaacgcaccgattagattttttccaagcggatggttcacggctacttttcctccgactgcgctgtcatgtgccaaaagcgttgtaggcatttgaatgaaatcaatgccgcgcataaaagtggctgccacaaaaccggcaagatctcctacaacaccgccaccgaatgcgatgatgcatgaggagcgatccaaatgaaaacgaatcgcttcactctgcaattttgtgtacatgtccatggattttgcctgctctccactcggtaccgtcacttttttcacaggccatttatcttgcagcaaatgaagtatttcatcaccatacaggcggtctacttcttcatccgtgacaagcataatccttgttaaaggcctgtttaaagaggttaatagttcgcaagccttttttctgataccttgtccgataaaaacaggatatgacgaggaagcagtttgaacatgcagtgtcttcattaaaattccctcgacagttttctcatattctccacattttctctaatgcggtcaatttgatctaatccgaattgttcaacgactgcgttcgcaatttcccaagcgacagccgcttcagcgactacacttgccgcaggaacagcacagctgtctgaacgttctatgctggcggaaaacggttctttcgtttcaatatcgacacttttcagcggtttatacaaagtcggaatcggcttcatgactccgcggacaacgattggcattcctgtcgtcatgccgccttccagtcctccaagtctgttagtagcacgggtgtatcctttttcctcgtcccaaatgatctcgtcatggacttcgcttccatttcgccctgctgcctcaaatccgatgccgaattccacacctttaaatgcgttaattgacagaacagcggcagcaagcttgctatccagcttgcggtcataatggacatagctgcccacgcctaccggcattccctcgacaatgacttctactattccgccgatggaatctccgtttgcctttgcttcatcaatggcagccatcatttttttgcctgcctcttcatcgtagcatctgacaggagactcttccgttacgcgctgcaggtcttcaattgacgtatattctgttttttcagctttaacagcgccaatttgcaacacgtggcccgccaccttaatgccaagctcagaaagaatctttttagctacagcccctgccgccactctgacagttgtttcccttgctgaagaacgctcaagcacatttctcatatcacgatgattatatttaattgcaccgtttaagtcagcgtgcccaggtctcggtctggaaatctggcgcttcatttccttttcttcatcttctgtaattggagcggcgcccatgatttttgtccaatgcttccaatcgttattttcaactacgagagcaattggtgaaccgagtgtacgtgcatggcgcaccccgctcataattttggcctggtctttttcgatctgcatgcggcggccgcggccgtgtcctttttggcgtctggcaagctcaaaattgatatcttcctccgttatgtaaagcccggcaggtacaccctcaataatggttgtcagttgggggccgtgtgattctccggctgttaaatatctcatgacttcttctcccttcatcgcattaacgcttttaagtaaaactactataacatatttttcagcaaaaagtcagtctatcttttttgataaaagaatgtatcggctgggactaggccaaatttctcggggttgaagatttgctcggtgctgccgacaaaaagaactccattcttcttcaagctatgtgccatttttaaatacagctcttccttcgcgctttctgtaaaataaataaatacattgcggcacacgattaagtcaaagtcttgttcataacgatccgccagcaaattgtgctttttgaatgtaatattctttttgatttccggttttacttcataacttctatttgcgttttgcgtaaaataacgatctttcacagatagcggcacttcctgtaaagaccgctcctgataaacgccttttttcgctttttccaatgctttttcatcaatatccgtcgccaaaatctgatagcccggaagacctttttgctggtccaaaagcatggcaagcgtgtatggctcctcccccgttgagcaggcggcactccaaatctttaaaggcctagaggtcttgattaacggcagaattgcagtctcaagaacttcccaccttttataattacgataaaattctgaaacattgatcgtcattctgtccaatgtttcatttaagagagcttgatcctcttccaatgccgccgcaaagtccttaaagctttggaacccctttttctcataaagtgacgttagccttctcttcatttgtgcttctttatatagtgtcaaatcgactccggttaattgtttccatttcgttgtaaatacgctgtatgtatccatctctactctcccagtctcgctgtctttttgtcctagtatagcttgttttatcaggaaattgtattgtttcaataaaaaaatcagcttttcagctgattttagatcgttgggaaaggcagaggtctgatgcacattgccattcaaccctttattcactttaatgtaaacctttacaaaacagatcaaaaaccggcggcgttatatgatgccggctctgttacttattttcacaatgattaatagatccagcctgccataagctgctgatatgatactaattcttcattcttaaagaaaatgttaatctcgcgttctgcactttcgagagaatcagagccgtggatgatgttttttccgacaaacatgccataatccccacgaatcgtaccaggtaaagcttctttagggtttgttttcccgatcagctgtctcgtcacttcaatgacattttcgccttcccacaccattgcgaatacaggtcctgaagtaataaactcaacgagctctccgaagaaaggctttccttgatgttcggcgtagtgtttctcagccatttgttcagtcactctcattaacttggcgccagctaattgtaagcccttacgttcgaatctagataaaatgtccccaatgagctgacgttggacaccgtctggtttcaccatgataaaagtcttttccatcatattctccaccccatcattatgtatgtataggctttcacactgcacaccgaaatcgtaacatctttctgataattaatcaatccggggcggagaaatttcttaatatctacaaaaattaaaattttcttttaccgatatattttgcgatggctgcaagagacgagcgtgcgcgccctcgaggaagcgtgtttaatttctgaaaagctttctgcagatacatttcgcttactgccatagatgcttcaattgcatctgtttttttgatttcttcaatgattggttcaagctgttcctgcgttgtctcactgttaatcaatttaagctggttttttaatgcaggatttttcagggcatacagcactggcaatgtgacgtttccttgaagcaaatctcctccaacgggtttacccagttcttcttcagttgaagtaaaatcaagaatatcatcaataatctgataagacatgccgacgtaatacccaaaccagtacaatgccttatgaatcttctcatcagctccagacgcaatagcaccaagctggcagctgaccgcgatcaagagagccgtttttcttttgatacggcggagatacgttctgagattttgttccatgttgtatttgtctttgatctgctcaatttcccctagacaaacttcaacgatcgtctgtgacaaaatcctatgggctttcggttcgttaattctcgtcatcatttcaagagatcccgcaagcatataatcgcctgtgtacatcgcaatacgattgtcccactttgctttgattgtcggttttcctcggcgaagctccgcatcatcaatgacatcatcatgaaccaaagatgccatgtgaatcatttccagagtgacggcgacatatttaatcttattaatatcgtaatcgccaaacatgccggaaagcagcacgaaaacaggacgaatacgtttccctccggcctgcagcaggtgaagacctgcctcgcttaaaagcgggtaatcggaacgtacggtttgttcaagttctctttcgattacatcaatatcgtcatttaaaaaagagtaggccattttaaatttcatatcattcacccaaacatctgtgttttcatttccatccgatatgcgtggcagcgactccgccagtaaacgaatgatatttaacatttttcaggcccgcctcttcaaacaggcctgccagttccttcattccagggaaatctctggctgattcttgaagccaagaatattctttatagctcttcgcaaacagtttcccgaaaaacggcataatatacttaaagtacataaagtaagcctgtctaaatccgaacatttccggctgggacgtttccagacataccacctgcccgcccggcttcactacacgtctcatctctttcagtacagtcaagtaatcagggacattgcggagtccgaagccaatggtgacataatcaaatgtatcatcatcaaaaggaagctccatcgcatttccgtgcagcagttcaatttggctgaatccgccgtcttttactttctgctcgccgacactcagcatattttcactgaaatccaagcccttgatcgcgccgcttttgccggccgcttttgcaagagcgatcgtccagtcagccgttccgcagcagacatcaagtgcttttgcgccttcttttacattcatgatgcgcatcgttttgtcgcgccattttttatgctgctgaaaactgatgacagagttcatttggtcatagtttttatatattttttcaaatactccgtgtacgcgctgttcttttgagtcctgcataatggtttacccttcttccactttctgatgataggtttgatcttggctgattgtcttcagacggtttattaaaatgttctgaataggtgaatttagaggcagaagtgactcaatgctgtttttcgcttttttaaaacaaacttctaatatctcttcttttgtttttcccagctgtataaaactgccgatcacatccagaaatgcatcatttccgttcataagccgcttaaatacaaaaaaatcactcgacagctttttccagcgcgggaggttgaagtgttccgccacacgatggaataaagctgattcaacgatgccgacactttcgaaaaaatcgttttcgtccttgaaagaacggtcatatagacgaattttatgttcgttgatttctttaatggctgtagcaagcgtccgaatcatgtagatatccttcatttcagatagtaaagagtagtacagcccgctgaaataatcgcccgcgagaacagtcaattggcggtttttgttttcgtctcgttttatgactctagctgtcgtcacttcatcatgggtatcaagggcgctttgtacaagcatcgctgttacaatataattttctctgtcgttgttttttatgtcagcttcttcaaataaagcatgaaaaagaagaagcttatcctcatcaattttcggcgcagaaatatgcttcgctaaataaggatgagacagcttttgttttaatttcgtgttcagattggctaaagttccgtagatgtcttgcaaaaatatcacccttgtccccaaattcacatttatttcttaatctatgtatgagttttatcttttcattcgcttacgcaggtatcattatagcataaaaaaaagaaattggctgtatcctcccgctgtttgcgagcatttgcttttaacagcggggacagccagcttattttttttcgcttttcatttctccgtacgcggtttgaatcagtgcctctcctctgactttaatggcagaagtatgctctgtaaactgagcgatgatcacttctcccttgtcgagtttttcggaatggtgaaactttgtgtctgttcctcttgtcaggccgatcacattcactccgtcctcaacggctttaatgacgacaaaatcacttgaatgcttttggttcatttatagcaccctctatctttattagtcctggcgtttaatatgttccaatacttctgcacgggcagcggcatcatctttaaaaacgcctctgactgctgaagtcacagttttcgcacccggttttcttacaccgcgcatcgtcatgcacatatgttccgcttcaaccactaccattacgccatgcggatcaagcgtttctacgatgctttctgcaattgtagaagtgatgcgttcctgaagctgcgggcgctttgcaacggcttcaacggcacgtgccagtttgctgagtcctgtgacctttccgcctcgcgggatatatgcaacatgtgcttttccataaaagggaacaaggtgatgctcacacatagaatgaaacgcgatatcttttacaagaacaagctcctcatggttttcaccgaagatagtctggaaatgttcttttggatcttcattcaagccggagaatacttcggcatacatctttgcgactcttttcggagtatcaagaagcccttctctattcgggtcttctccgatcgcttctaaaatttgacgaacagcttgttcgatttgctctttattaacttctttcatgttctatgtcctccaccaatgaatacatttaatttcgattctagcacatatgccccgctaaaagcaaagtgaatgccctgtcaggaagcccatgctcttgaaatatgaaaagccccttagaaaggggcttttctgtgaagaaataaagtgtatgtaagctagatgcatacacgatctatattcacaattattttccggcaacagcgtctttaagcgctttacctggtttgaaagcaggtactttgcttgctggaatttcgatttcttcacctgtttgagggttgcgtcctttacgtgcagaacgttcacgcacctcgaagttaccaaaaccgatcagttggattttatcaccgtttttaagtgcatctaagatcgtatcaaaaacagagtcaactgcttttgtagcgtcttttttagacaattcgcttgcttctgcaaccgcattgataagttctgttttgttcatgcctttcacctcctcccaaaaggatacattcagttcgtttattatcatttcttcacagttcagtctgattctaaacctgtctcagaaaaaaatgagagcaagtaagagaaagacaattaaacggcttttaagaaaaactgcactctgaggaatgtttgtccaacaaagtgaagaatttctgtatgtagagtaacacatataaaaagccatatcaagcattttaaagcgtcaatcccttgctcgtcaaggatttaaggtgatttaccgaacaaatattcctttttttccttttttcatcctattccttgatccttttccattattaagagcaaagaaaaaagacctcccattctataaagaggtctaccggtattacaggatgatggcgattaagccgccagagccttcgtttatgattctttctaatgtttcttttaatttataccgtgcgttttcaggcattaatgacagctttgcctgaatcccttctctcacaattgagctcagcgaccttccgaagatatcggagttccagatggagagcggatcatcctcaaagtcctgcattaaatagcgtacaagctcttcactttgtttttccgttccgataatcggggcgaattcgctttcgacatcgactttgatcatatggatcgacggagcgacagctttcagcctcacaccgaatcgcgagccctgccttataatttccggctcatcgagactcatatcagctaaagcaggcgctgcaatgccgtatcccgtctgtttgaccatttttaaggcatcagacacttgatcatattctgttttcgcatgggcgaagtcttgcatgagctcaagcagatggtctcttcctctgatttcgacgcccacaacttcttttaggatttgatcatatagatgatccggcgcgtacaaatcaatttctgccaccccttggcccagctcaattccggctaatccggcactttcaatgaattcaaactcgctgaattggccgacaaccctgtctacgtcccggagccgtttaatatccttaaccgtttccttcacggactcctgatagctttcacgcagccaatggttttctttcagcaccattacccagcttgggagattgacattcacttctagcaccggaaactcgtagagggcctctctgagcacactcagcacatctgattcccgcatgctctctacactcattgccaatacggggatatcatatttttcgcttaaatcctggcgcatggcttccgtttccgggtgatacggcctgactgagttgatgaccataataaaaggtttgccaacctctttcagctcttcaatgactctttcttcagcctctatatagtcacttctggcgatatctccaatggtgccgtctgtcgtaatgacaactccgatggtcgagtgttcttgaatgacttttcgagtgccgatttcagcagcctcatgaaatgggatcggttcttcgtaccaaggcgtattgatcatccgcggcccgttttcatcttcatatcctttagccccgggcactgtgtaacctacacaatctactaatcttatattcacatcgagtccgtctgacacatgaacagacatcgcctgattcggaacaaatttaggctctgtagtcataatggttttgccggctgcgctctgcggcagttcatcctgcgctcgggcccggtctgcttcgttactgatattcgggagcaccacaagctccataaattttttaatgaacgtggattttcctgtacggacagcacctacgactcctaagtatatatcgcctcctgttcgttcagcgatatccttgaaaatatcgaccttttccaagtgatcccctcccggacttcctatccttttcaattttattaagctctttcaatcaaacacaggacactatatgtgtatgacgttgtcctatttgaatatgacatctttagaaaatttctcatcctcaatctattaatataaaaaaacctttctccctatttgtatgcaagggagaaaggttcattcctttttcatatcattttctaaaaaaacaggttcctgtttgtcatttaccgtatattttacagaaaacgcggggacaaagggggtttcctgccaaatcatatcctggatttcagtcccgggtttaaacgttttcttgctttttttgaggcaagaagccagctcagtccggtaatcagcatatatttctccgtctccgtcaatcataagcggcaaggaattccctgagattgggcttgtcactgtaagagagcttccatccccaagcttcttctcatcgagtgtaaataaatcacgagatagcacatctttgtaaggcggatattgatgctcctgacgatacatttggatgcgtaatttcacatcgcgaattttttctgccatctttagatcaattaatttaacagtcggatcgttctctacgtcaacaagcacgtattgatagtctcccccgctttcaaatgccgtacttggaggttcagctatgtatcttggcgctaaccggttaaagtctatcggatatttttgatatagcggtgtcgacatatctttggtttgaatgggaagcagccccccatttgccttttgaaattcatcaacagcagattgaacctgctttagctggtcttgataaggaatggcatgcacactgcttttccgttcatttggatataaacatccggataaaaacacgactgccgcaaaaatgattgcacacttcagtttacccatacagcacttccttttacagctttattcattgacagggccgctaaaaaccacgacaaacacaataattccagatatgagcatacacatgtatgcgaatgatgaaatcgcaatcttcaaaaaacggtttcggcatttaaagcggcttaaatagatggaagctacagccagaaacatcagacccatggaccctagagcaaaccacattttcatcaatgccagattcaatgacgtgcgcctccccgatatgtatgatgtaagcgttatattatattttaatatacagcgccggaaaagatcaaccagattttccatcctttgatagaacaaaaaaactgaagcaaagagggggaccttcgcttcagtcaacttgactatattcacctgcacgtttaagaaacactctcttggacttcgatgctatagtatgcgacatggcatacagatgcatcctctattgcctaaatcggcaaaatgtttcaggagatcccaagacttgggtgttcttctgtttttcgggctttcgttcaattaagatatgcgatccatcatttgattgacacttttacttcacttgattttcaaacgtatttaccaaatcctccatctcgtgggttttccctctcgccattaaagattcaacagcggtttccactttttgtccgttgaataggacctgatggagagcttctgtaatcggcattttaacatcatatttcttcgaaagctgataagccgctttcgtcgtgcgaacgccttcgactaccattcccatctcttcaagaacatcttcaagcttgtacccttttccgagcaaattgcccgcacgccagtttctggaatgaacacttgtgcacgtcacaatcagatcgcctactcctgtcaatccagagaacgtcaagggatttccgcccattttcgttccgagtctcgcgatttcggcaagtccgcgtgtaatcaaagcagctttggcattgtcgccgtaccctaaaccatctgtaattcctgcagcaagggcaataatattttttaaagcccctccgatttcaactccgataatgtcaggatttgtgtacacccgaaaattgtgattaataaatagatcctgcacctcttctgctgccctcatgctctttgaagatgcagtaacagttgtggggtgccgtagccctacttcttccgcatgactcgggccggaaaggacaacgatatcttttctgacatcactcgggagctcaatttccataatttcagaaatgcgcagaagtgaatctggctcaatacccttgctgacatgaacaaagactgcctttttcgttataaaagggacagcctgtctcagcacttcccgaattgcttttgtcgggaccgcaacgataatgaaatccgcgtctgaaacagctgtcttcatatccgttgttgcctctattgattctggaagcttgacgttcggcaaataatctttattttcatgctgatcattgatttgatggatcagatctgcacggtgcccccacatggttacatcgtgatgattatcagctaacactaaagccagtgctgttccccagctccccgctccgagcattgtgacttttttcatatttgcttcacacctttttattttctagctcttgcaaatattttgattggtgtcccctcaaaaccgaacgcgtctctgatccggttttctaaaaaccgttcgtatgaaaaatgcatcaattccggatcgtttacaaacacaacgaagcttggcggctttaccgacacttgagtcgcatagtaaatcttcaaacgagaaccgttatgagtcggtgtcgggttcattgccacagcatccatgatgacatcatttaagacgtttgtctgaactcgaagtgaatgattttcacttgctttaataatcgcaggcatcagcgtatggatccgttttttcgttaaggcagacataaataggattggcgcataatccagaaattgaaaatgatcgcgaatattttcttcaaattctttcattgtgctctcatctttgtcaacagcatcccatttgtttacgacgatgacgacggccttgcccgcttcgtgtgcataaccggcgatacgcttgtcctgttcaataatgccttcttcgccatccagcacaaccgccacgacttctgagcggtcaatcgctttcagcgcccgcagtacactatacttctcagtcgtttcatagactttccctttttttcgcatacctgcagtatcgacaatgacaaactcctgctggttgtaagtaaatgacgtatcaacagcatctcttgtcgttccagccacgttgctgacaataacgcgttcttcgccgagcatcgcattcacaagtgaggactttccgacatttggacgtccgatcagacagaattgaataacttcttcattgtatttcgtttcaggaatgtttttaaaatgctctgcaacggcatccagtaaatcacccagtccgagtccgtgtgttcccgaaattggatatggctcgccaaagcctagcgaataaaaatcataaatattcgctctcatttctgtgttatccagtttattaaccgctaaaacaacaggcttttttgtgcggtacaaaattttcgccacttcttcatcagcagctgtcacgccttcacggccgttcaccataaaaataatcacgtccgcttcatccatggcgatttcagcctgctggcgaatctgcgctaagaacggctcatcaccgatatcaataccgcccgtatcaatcaaattaaaatcataattcagccattcagccgagctgtatatccgatcccttgtcacgccaggggtatcttctacaattgaaattctttctcccgcaatccggttaaagattgtggattttcctacatttggtctcccgacaatggctacgacaggtttacccatagtacccttcctttcaatccagccgctttcatttttacataaattttcaaccggttattaaaatcatttcattcacttttatgaaaagaaacccttcagaggaagggcttaactcatttattatatcagtttttactgggatcacaactattcttaaaaatgtttcacgatcaaatacacgtcatctccgattctgtgagctattccatcaaggatcgcttcaagatttttagcgaaaagctccatctccttttggtcattgcaaaaaaagacaggtgctcccctgcaacccggtttcgatttgtcgtgattatagacaaaatcactttcgtaagagattcactcatcctatcaccttatcctgattcttgataaattcagtcggcattctaatcgcattttccagggttggaacattgctaataatttgaacagccgtttcgggatggtgaatttgcgggagaacaaatactgccactctcccatcatttaaatcccgttttgcaattggtgtcaaagatggctctcctgaatcccgataaacccgagcacattggaaacatcaaataaaatggcctgacgctgccctaaatttgctatcgtcgctgctgaattaaagttttttggcgttaagataaagcccatgccatgctttaaaatcagttcctgtttctctggaagcccgatattcatcatataaatattatcaataaacagtcccggaccgtcaaagcgcggctttatgtactcgatgtctacaatatccttcaacacactgcccgacataaacttcatggccagtaaaaaacaaacgacagccgctatgactgcagcccagatggataaaaacacatacgcagaggttgtcaaaagcgctgtaaagatcacaatataatttctgctttcaaacgcaatggcaatcccctcaatatatgtgcttcctcttgagacaagctcatacgaatccatttgcgtcaatgtgttccgctccatgtttcggacatctctaaattgcgtcgctgccaatgttaaaaatgtgatggccgtaaattcctcctgcaaaagcgccggcataataattgcacctaaaccagccgctatcaaccccagtgcgatgtgaatcactttcccatgaacataggtgggatactggcggtaatctgttttcagcatataaagccttgtcgcaattccggcaatgaccccagcaataatcggatagatgtaatcactcatgacattttggtagctcctttgtttgatcttttgcttttctgaccaatctggcttgcgaggtgttcgtatttagatatgccaaacagcaatatcatccccgcagaacacgcattcagccattgaaagccgccgacagccatagccccggccaacttctggatcacaaatgaatacaccagttcgccatggcacatccctaggacaaataagacaagctgcttctcaaaattcctttcaacagaagctgttaaaagcactattaatataacagcagcccactcaggttttatgatgaaccaaaccgggtcatataatgcaaaaagataaacaaacgcatacgcggcaacaagcgtcaaatagaccataatgtaacgaaaacgatacattcccaaatacccggcatagacacatccgcaaacgaaaaacatcaaatatgcagcattcagggaaaaatataaagcgatgtcatgtatgcttagaataatattagttaaaataaagacagagacggcaattcgtcttttcgtcttttcaaaaataaatgttgtcagaacccacagaaaccacattgaccaatagtaataaaattgttccatttgacttcctccatattcccagtatggagttcaagctcattttttaaacaatctatctcacattaaggagtatgatcatgggaaaagacagacaagagaaaaaactcaaagcttcaggcagagtcgaatcagaccgcgaccagtccattcactatgacggagcgacaagccttgaacaaaacggaagattcaaaaagcgaaaatcataatacaaaaagcccaaaccacatatggttttgggcttttatcatttatcgcacactatagcttgatgtattgatccctctctctgtgagccaatgatgggtttcacctttgatcacaaggggcgccttttgtaaatcgtcaatcgttctggcgcccagcacggtcataatcatctttaattcctcaaggatcagctgaatctcctcaagcagtccttcctcaccactgtcagtcagcgcttttaaaaaatgccctgccattccggtgcaagaggccccaagcgcaattgcctttgccacgtcaagtgcatcttgcagaccgccagaggcgatcatggtgcttgcaggaaactcagagcggatttccgccaaacttgcagctgtcgaaatgccccacgagttaaaaaaggagatttgccgctgtcttcggagattttcgattttcgagaaatttgtccctccgtaaccgccaatgtcaacagctgcagcaccagcttcatacagctttcctgctgattctttgctcataccgaatccgacttctttcacaatgactggtacactgacatgactgcaaatttgttcaatacgttccagtgcgccgctaaagcttctgtctccttcaggcatcacaatttcctgaatcacattgaggtggatctgcagtgcgtttgctccaatcatctcaacggcttcctttgcctgggcagccgttgcctcgcttcccaggttggcaaaaatcagcccgtttgggttttcctttcgaacaatttcataggaaagacgctctgatggatcttttaatgctgacatttgcgatcccacagcaaggggaattccagcctgagaagccgctcgcgcaagcgatttattaatttcatatgtaagttttccgccgccgccagtcattgcattgataaaaatcggcgaactgcttgaaagttcgccgatttttgtggaaatatctacttgttctaatgcaagatcgggcagactgacgtgaacaaacgtaatatcatcaagacctgtttcccgcttctggccggtggacaaggcatgattgatgtgttgtctttttcgttctgctcgagtcacgtttatcaccaattattttagtttattcagcttatctccgatcagatctccaagctggaagccagtgcttgtttcttccttcgcttgatattgacggtaatcttcctgatcagctttgggcgtttcttcaagttcacgcatgcttaatgaaatgcgctcctcattttcattcacatcaagtaccttcacttttacagtctgtccttcttcaaggacttcatgcggcgtgccgatgtgtttattggaaatttgagaaatatgaacgagaccttcaacacctggaaggatttcaacaaaggcaccgaagcttacaagacgctgtacagttccttcaagcacatcgccaggcttcactttttcgccgatttggctccaaggtccaggcagtgtatctttgatcgataaagaaatacgttcattatcacggtcaaccgataacactttcacttttacttcttgtccctcttcaacaacgtcagacggcttctctacatgagagtgggaaagctgtgaaatgtgtacaagtccgtcgatgcctccaatatcaacaaacgcgccaaaatcagtcaggcgctgtactttgccatcaagtacacttccaacttcaagagactgaagaagttcttgttttttattcgcttgttcactttcaacaacagcacggtgtgaaaggatcacgcggtttttatcacggtcaagctctacaacgagcagtgacagtgtttttcctttatagtcagtgaagtcttcaacgaaatgtgcttcaacaagtgatgccggaataaaaccgcgaacgccgatatcaacgacaaggccgcctttcacgacatctttcacttcagcttcaaacacttcttttgtttcaaattttttctcaaggtcttcccaagcgcggtctgcatcaacagcacgtttagataaaatcaaagcatcgtcttccacttttgttactttcaggtcaagctcgtcgtctactttaacaacatccgatgctttctctacatgaagacttgataattcactgattggaataataccggattgtttgacattgataatttctacatctacatgtttgtcttctacctttgtcacaatccctttaactacatctccaacctctggcacttgaacatcaatttgattcatttcctctgtcatttgaataacctccttggtccaaacctacacagcttaattaaaacggtttgaaagctgaacatataacatgcccgcttttagccgaatatgtattaaagaatcatccaaaaaagttttttgaatgatcaataaaaagttttattagtattaacttctaataaaaggacaggtttgtcaagcaataacattctatcttcgttgaaaaattcaaaaaaagtggcatttgccatcctcagcgggacttttgctccacagcctcgaggattttatcagctacctcttgaatggaaagcgatgtcgtgtcgatttcaagagcgtcttctgctttacgcagcggagatacttcgcgctctgaatcaagcttgtctcttcttgcaatttcctcaattaatgtttcgaagttgacatcaaagccttttttcacattttcttcataacgacgtttcgctctctcttcaacagatgccaaaagaaagatttttacttctgcatttggcagcacatgcgtcccgatgtcacgaccatccatgacgacgccgcctttttccccaagctgctgctggcgtttcaccatttcttctctgacacttctgtgcttggccgcaattgaaacttggttgctgacttcatctgttctgatcgcctcagttacatcggtgccgtttacaagcactttttgtccatcttttgttgtaatcagctcaatgtctgtccgctttagcagctcagccagtttttcttcatctgtcagatcaacgttttcctgtaaagccgcgtacgtaatcgcccgatacatcgctcctgtatcaatatatatgtacgattttttctcagccacaattttggcaacggtgcttttccccgcagctgccgggccgtcgattgcaatcgataatttcttttccataattcctctccttgctcttttctcctctatggattgtatcacgaactttatgaaaaagggtgaaaaattgatgaataattaatgtttgaaggtttcaatcctattgttttcctccattttatccaccccttcatattgaatcacttttgatacgtatggttcaatatgctgatagtgaaaaagaaattggacaccaagtaaaatgatggcctgaatgaacaataatttgatcagcagccgttcaaatgttttcattggagcacctccattacaaatagtatggaagtgtttgccgatgtttattccattcgggcctttcttctcttatttaactggcgccggatgcagtattgaagcaaagcctgctggtcacctgctgcaatttctgaatactctaaagtcatttttcgtttttctgacttggggtcattaaagattcgtctgacaactgcttctgtttctatttgacgtgagtgctcctcttcaggaagacggatgatcaggcgcaatgattccccgattgaaaagaaaggccatcagctaaaaccacggcgatgccgcctgcactgatgttataagatagtgtgcggatctcttcttcatttcccggctgaatttgcacatctaataccgcatcagttcttacatattggcggcgctggattcttttcattttttcacgtggaggcacttcaagacagatcatttgaagtttgtccttcactttaccttttatacggcttataaagcgataaggaacttcgtcttttcccacaaactctaccgttacttccatatcgttatgtaaaatcacagttcgccctgtaactacatcaacaggatacgcgatcaaaagttcattgttttcgatgctgaccgccttgctttttgcctttttcaattcattttcttctatatattctaaaagtacagtttctccaatctctatcattgacttcactctttcgcattcaatatactcacgtttttattaaagcacgtaatgaaaaaaaggaaaagacatttagtcctttcctcctgtttttacaggtctttatatataggttctgcattttttagtttttcaaccttttcttccgatccgtctttggcattgatatacattctgaatgtgtcattttcaattgttccaagcatttcgtaacataacacttcttgacctagttcatttgtaatcaaagcgagccttgtttctctcacttgtacatttttatttaatttagactttgcctctgcttcagtaattgcaggcttaggtatggttctttttctatgagatgtgaggaagtctcttgctgaaaagccgacaacctcaccgtcatccaaggccactttcatacgaattgcctccgggtacatccggactttattttcaacaggaacatatgaaaatacaccgattttatcatattgggcactttcatcaatttccaaatcatctgtttcaaatccgtttttctttaaaaatgcaagcgctcggttcgatccgtcatttaaactgattttctgatctttcacttctctgttttggatcaagtataccggatgcccgcccttcttcgtaatatccatataaatcactgctttatggtctgggtctttcatgctgatgctatatacatcgcgatttgttttttttccgctctttaccactttaattgaataattgtcatctggggcaaagcgctcagcaatttgttttgcttcctgttcggaaatttgttttcccttcagatggctgaagcctttctcttcttttttcgtgctggtgaaactcgggccaagatcagtgccagtggagaatgcaccaacatttttttcgactgttttaaagctgttgataatcgtattatcactttgtttttcgtcagaagccagggccatttctacgtccatccagcgaaggtttttgctcatgacaaggtgctgaacatggcgcaattcattttgtatatcttcggactgctgatatagcttatttagtgatgtatactcgtttttatcaagcggcttttggtccaaatctctgactgacgttttatagctgaaatcgccgatctttgataatagctcttcagttttattaaacggcattaatgtaagcggcagctgactgacgctgttatgagcttctgatgtaatcctccacacatcgatcaatgcaggcgacagtgatttttggctgttcatggcaagtgttgttccgattttatcatgaagctgatccacctgataggtaagctcatgaaacgcccgctgatagttattttcagcatgaagaagaactgcgtctttttcctggtgttctttgtatccccagtagcctgtaccgactattgcaataccaagcacggcgattaaaattcctctgatcatttatcacacctctttttatgctttctcatatctgctactcacagaaaatgtgtttaccgattcttttaatctgcggacgcccccaaatccacggacttgtagccgtatccggattaaagtagtaaagtgcttcctctgatggatcccagccattgatggcatccagcactgcttctcgtgccgtttcattcggctgcatgtaaatttgtccgtcggctactgctgtgaaggcaagcggctcaaaaataacccccgctactgaatttggaaataacgggctgttcaaacggtttaaaatgactgctgcaatagcaacctgcccctcgtacggctcgccccgggcttcgccataaaccgcttgagcaagcagcctgatatcgttgttggaaaatccaccaggcatgttcgctgctaccgcatcctgttttcttgcttttgctggtgtattgttttgctgtttattcgcattcgctttaggctgctgcgttgttttttctgcaggctgtttctgccgtgcttctgcttgttgtcttgccttttgtgttgctgcttttgatggtttcgtctgatactttagcggaatttttccgtaatgcgtgaatgtattccctttattgagctgttccatgacatattcacgatagtattttgatttacatattaaggtttgctttgttttagctcctacaaggccgtcaacctcttttaatccgaattgatcctgaaaatttcgaactgcccagtacgtcccccatccataaaccccgtcaatttttccgttataatatccgttgtattgaagacgcgcctgaagctcgaccacatcatcccctgttgcccctctttgaatgacctgattcgaaaaggcagagatcgtttcagtattaataaacgtcgttattgtaaaggaaaaaaggatgagacatgccataatcgatcctttggacttcatcttttcaagcctcctactgcaaatttttaagtgtaatcgtattttctgtaacgaggttatttttatacactctttccttgttatccctcagaacataaaaactgcacacaaaaaagccgcacggttgctgtgcggcttctatacttgcatcatattaacggaacgggcttttttcgctttacgcaaaccaaaccaccataaaaataccataaatggaagcatataataaatccaattgctaagcgctgttaggataaaatcatatgatccatgcaaaagggatgggacaactaaagaaagagtaagccactttacacgcgccttatcagcggaaaaacgggcttttccaaggtaaaatcccattataacgccaatcaaggcatggcatgaaacaggcagcagcgccctgacaaacgcatgctccacgccgtggccaattaaataaagaatattttcgagggttgcaaaaccgagtgatacacttgtaccgtacacaatcccgtcataatgctcatcaaagtgggcgtgcgggtaaacactgatcatcagtataaaccattttaatgattcctccaaaaaccccgaagataaaaaagaaacgaaaaagcttccgcctcctacattctctttttcaagtacatactggataaacattatgggaaatacaagaacaaccccgagaaaaaacgaccgtagcaccatatgtacaggttcattatcatactgatcttttaaataaaaataacttaataacgcgatgccgggggcaattcctgcagagatgattgcaaacatcaggcaacctctttcctttatattcctacgtctatcctaccatgttgtttaaaattttacatctgtctgcacttaaaaaaacaaaaagagcatacgaatgcatcatatgctcctcatctttaatggttttctcttttggcgatttccgctgcgatatgccccccgtgaaacctgccgttttcaataaatatttcatttgcattgtttcccgcagcaataacaccggcaataaagacaccttcaacgttcgtttccatcgttttttcgttgaaaaatggacgccctgtttctttatcaatttcaacaccaattttttcaagaaattgatgatcgggatgatagcctgtcatggcaaatacaaaatcatttttaatggtaatgagttctttctctccggagcgaaacacaacttcattctcggtgattttttcgacacaagcgccaaattccatacggattgtaccgtttctgacgagagcttcaaattccggcagaatccacggcttaatgctcggagaatactcattgcccctatataaaactgtgacacgcgccccagatttcacgagttcaagggcggcgtccacgcttgaatttttcccgccgatgacaacaacatctttatcaaaatacgggtggccttctttaaaataatgaaatactttcggcaaatcctcaccgggtacgcccatatagtttggatgatcataatagcctgtggcgatgatacaatatggcgtcttgtaggtctcttttgacgtctcaataacaaatgtattattttccgttttcgtcactttatgcaccatttcaaatgcgttaacacggatgtttttccgtttgacgacttcccggtaatacgataaagcctgaattctgacaggcttcctgttttccgtaataaatgccacatctccgatttcgagcttttcacttgagctgaaaaaggtttgatgcgtcggataattgtaaatactgttaacgacattgcctttttcgatgacgagggcatcaatgccaatttgttttaggtgaatggcagcagatagtccgcaaggccctccgcctataataattgctttttcttgaatcatttctgtcaactcctgcattggcatttcacttcatattttctatttccgaataaaaaaatctcctattttatcataggagattttttatttttatgcaaatcatcaacttatatccagcctctaaaacgcgaagcttcagccattttgcgaacgccgaccatatatgcagcgagcctcatgtcaattcttcggttgttagccatttcgtaaatattgttaaatgatttgaccatcattttttctaatttttcttctacctcttcttcactccagtagaagccttggttattctgaacccattcaaaataagaaactgttacgccaccggcacttgccagcacgtctggtacaagcagaatgtcccggtctgaaagaatttttgttccttcaagcgttgttggcccattcgctgcttcaacgacaattttagcccggatattatgggcattttcttctgtaatttgattttcaatcgcagcaggaacgagaatatcacaatccagctccagcagctcttggttggtaatggtatcgttgaaaagctttgttacagtaccgaagctgtcgcgtcggtcgagtaaataatcgatatcaaggccttccggatcataaagtccgccatacgcatctgagatgccgacaacttttgcccccgcatcatgcataaattttgccaaatagcttcccgcgtttccgaagccttggacaacgacacgcgcacctttaatatcgatgcctctcttcttagccgcttctttaatacagatggtaacaccttttgctgtcgcagattctctcccgtgagatccgccaagcacaagcggtttgcctgtaataaatccaggcgaattaaattcatcaattcttgaatactcatccatcatccaagccatgatttgtgagtttgtaaatacatccggtgccggcacgtcttttgtcgggccgacaatttggctgatcgctctgacataccctctgctcagacgctccagctctctaaacgacatatcccttggatcacaaacaattccgcctttaccaccgccatatggaagatcaattatgccgcattttaaactcatccaaattgaaagcgccttcacctctttttctgttacgttcgggtgaaaacgtatcccgcctttcgttggaccgacagagtcattgtgctgcgcacgatatcctgtgaaaatctttactgaaccgtcgtccatacgaacaggtatttttaccgttaataatctcatcggctcttttaacaattcgtatacctcttcgggatatcccaatttttccagagccttatgtattacggtttgggttgattttaatacatcaagtttgtcctcttctgtatgaccggtgtttcgatcggctgccatttgagttaacctcctagaatcttctgtttctcacatgctccctttcagagaatagtatacaccttcatatgatctgtgcatagaataaacgttatgtttttccatgttttttaacgaaaaaaaactgctgaaatcagcagttttccgttgcattcttatgaaaaatgagtttgtatcgtctctacggcattaccgtccataatgagcttaccatactcttgcaggcgataaatcgttaaagttgtcggattgccgtattcagccagaaccgccacaaccccttcagccgtatgtgaccctagatcttcaaggcttaaaaagtactgcccgtcatagtggtagacagttccccctgtgataccgattcgctgtaagctttctgaaagctgaatgatatcttcaaaggaatggaattgatatatgatgtccgcgctttcatcaagcttgacttgcatttcgatgtaatcatcatcatactcatcgtcttctgaatcggcgtcttggttctttgttacaatcacgaccatcccttgtgcttggagagaatacacttccactgcaatcggtccattcgcttcaaagccgagctctgtatttgcttcattcatcatatctttaaataactggtggactttaaatgagtccttccagaggtcttcttttgtcaatccccggtctgtcaaatcatcgagggttaaaaagattttgatcttattataattcagacgctcaagccgcataacgttccctcctgcctctacttgcacacaaatcatataacacattatatgagatgatgagtcataggttcttaattgttatcagtttacactgagttcactagtaagacaagcacaatgcagtttttattgccatacggatttttgctttttagaagttattctggcccgcaaagagtcacaatgtgtgtttcaggctcagcacctaaacgaagaggcacttttgtcgtgccgtagccgttgctgatcagatatgccgcgtttttaacaatacctgttttccccagttcataagggccgaattttccaaacctgatctggcctccatgggtatgtccgctgaatatcacatcaataccgtcatcttcattgatttgttcatgaatctccggattatggcaaaccagaatattcagctggctttcatcaagttctttgatggcttcctcataatgatccatctccatcctgatatcatcaacccccgcaatcgcaatcgtatgcccattgtatgaaaacgggactgactcatttctcagagtgatgacgccgtgtgctttaaatatggaatacagcttatgctgcctgacttcataatcattattcccccacacaaacacgatagggaccccgaaatgtacgagccttttgatgttttcctcgattctcgcactgggcaccccgccctcagctaaatcaccgccgattataaccaagtggggggcatggcttcgcgctttttctaaaaggtcttgatcgatgagacgtttgtgaatgtctgaaataaaaaagattgtcagaggcggcttgcccttcatctttgataaaggaaacgtatgtgtcttcaaatgattgccttttgctgttgcatacatttttgccgtcattgccgctgccgcaacagttagtacaccggcaattttcactgatagcttcataaaaaactctccattctttttagaacttatcaataagacggacaataaaaaaaagacgtttctatcgtttgagaaaacgccccattttatttactttcaaaatatagattaatgtcatatttgtgcttcatcatatgaaaaacagactctctcgccttccatttatcgggctgcggccagagatcagtgcttttctgaataatttcacatctcagtttatggaaatcagtctcggatttttcttcctttttcttgaaataatatgaagtgcagtaggcaaaagcggttgccagcatccaaaataaataaaaggtatggctaagtatttcttgaagtataagctgaggctccgggcttttgatcatgatcataacacataataagcctaggcagataagtgaagcccatcgccatctgcggcattgtgctgcataattttcgaatttttgttttcgttttaccagcgcttggagcatctgtttggtcggcgcgtctgtaaactgatccagctgattccataaggattccatacgcttcacaccttgtccattttcattgctacaatatatgaacgtaaaataaaaataataccctattcatccattaaagggatgtccaaaacttgtccggtgtaaacatcatttccattcagatgattatacgctcgaattttttcttctcctgtccggcttttataatacttcatggaaatgcggtatagcgtttctttcttttggacggtgtgcttgacaacgcgattcggcacattttgaactggctcagccggctgctgttgctgttgtactgttgattgggaagaggaagcagccgcggcggttgcttcctccttatttgccgagtcttctttttccgctacagcagtctgtttcttatcagcagctgtttgctcttttggcttggaatcttctggctctttttttgactccttctgcagtgcggtttctttagtgtctgcggtatcgtttttatcctctgatttcgggacaacctcatatttgctttggctgctgtcaataaaaacatcttcataatcgtcatgattatccgggtggctctttagataaaataaggtgactaaaacgataaccggcacaaatacaaatattactgcaagtactgtgaataatggcgtttttgttttgccttgcttttttttctgttctctttgattttttacagattgtcttgtcggaaggctttctccatcatcgacataatcgtccgccaatgcggcgttttgatcttcataaagattctgggcttttcttctctctactctcgacatgttcgtcatgtttatccctcctcacatgttcaaaacgaatctgacaggcaaacacggcatcaatgataaaatgcgccgtcatcggaacaaataagttgccggtccattcatacatcagaccgagcaaaaagctgattgctgtcaccataataaataacagccattttgacaaataccgaaagtgcagagcggcaaatataaggctggccgcccataaaccgatatgagtctgcagcactcccctgaataacatttcttccgcgaaagcaatcagaagcgttaaaaatataatatgagggattgacctcttactgaatatttttttattgattccgccgtcatcatataaatgagacggaaaccatttcattactgccatatcggctaaaataacaataacagctatagaaacaccataccagatgattcgcatatcgcgaatgtcccagagctttaatacgtcccgtacatcctcaaaaaagaacagtcctgctgcagcagcggcaaagatgatgagtagctgcgtcaaatataactgcttcagcatatcacggtcagacatatgctgaatataatctttttgctgtttcagttcagctcacctacagtctgcaagctgaatatccggtgcaattccgaactccagctgtctaatggcgccattttactccgttcccctttttgttcatacaaggataaatcaaaaccgcaatgtgaacagcacgggaggtttccgtcatcaggctcgtatgattcatcaaagtaggttaacagtgcctgccttaaacagccgtcacgctgaagcaaaaatgatacacggtgcattttttccagcttcagctccatgcgatatgaaatttctttcttcatcagttcaactgatgtttttccctgcataaagagatgaatcatcatacgggcctgtgtctctccgactccatactgaagtaatacgtcacgaagccttctctcatcccgctcctccgtcttctctagcacacggatcacgtcggcgatttcttcagctgtgacactctccatctggataatctgttcctgcaattcaaaatcccctggcgcccgcagcaaaatgctgacactcggctttccatcgcggcccgctctgccgatttcctgcataaaagcttctgccgtctgcgggaggtgaaaatgaatcacatatctgatatcaggtttatcgacacccattccaaacgcattcgtacaacatatcacatcaagctggttatgaataaactgctgctgaattaaaatcctgtcccctgactccaaaccgccatggtaaaagtcggctctgctgctcgttttgcttttaatttcacccgctaattcctcagcccatttccgtgtcggacaataaacaattcccggaccttgcaggttttcaaccagctgaatgaccctatctattttttcggcagtatccgccgcattttcaaccctcagtgcgatgtttgggcggttgactgagttgagatggcgtacagcatgctgcagctccagcaggttcatgacatcttgcagcgtttcctttgtagccgtggcggtcaatgccagaacaggcgggtgaccaagtttttttctcagctgtccgagctttgaataatcaggcctgaagtcgtgtccccattcagaaatacaatgcgcttcgtcaataacaaataggctgatcgggacgcttttcaatttttccaatacatatggagactgtaaagcttcaggagacaagtacaaaaatttatatcgatgaatatgttctaaaacaaattgtctttcctgcctgttaagcatgctgttcaaagctgcagcacgcttttcccccgggctttgagctgctgcacctgatcctccattaaagaaagcagtggagaaacgattaataccatgccgtcaagcatataaccaggcagctggtagcaaagcgatttccctcccccagtcgggagcattgcaatggtatccttcccgctgagtatgctttcaataatgtcctgctgcccttttttaaaggaagtaaaaccaaaaaactgatataacgtttgctgtaatttagtcatattgctgcacctgctttgtcaatgccagtctgatttgaaagtagctgaaccgctgttccagcccgtcgcgaatttgtttgattttattcgtccgcatccgtttggcaaactctgcgatttgaagctggtcttctgctgatacatagtcattaatcataaacgcaggctcatggagagaaatctcgacaatgtggtcttcgatcgtcgctgttttcagctttctgatttcagcaattcgatgtatcggaaacccttgtttgaccatctgccatgttttcctcgtcgactctgtcagggcattatctaagtgcacatcagaaaggagatcctttaacaaagcatcttcacactccggaagagaatgaataaaataatgtaccgaagcccaaaacatgatatagacataccattcatcttcttccagcgtatcagcaagctgcctgctcgtataaccgatccgatggtgcgaggttaaggagtagacaaaaatttgcgctgctttgttttcaatcttttttaaatgcgcctcaagcatggcaaaaaggctttttgccatctctatatgatccgtatgccgggacaggtatttctttacccagtgaagtgtcttatgatccttagtgacagggatatactgcctgctcccttgctgtttatgggataggacctgcacaagcagcgaaagccttttccaaagcacaccggcagcctgctgataatgagcgccgtgacaatgaacgggccaaggccgctcgctaagggcatgccttaaaactgctgcgccgctggctgtcactttgtatgtatctgtttcagacattggcgagagatatgaatgcttttcaagcttgtcaagcgactcagaaatatcgcttctcgaacattgcgccgccattccaaagtattttgcagtctgaaataagccggcatcttgaatggtttgtgacgacctcttgcctttgaataggtgaaaaacagcgcttcccgaccgttccccgtttattttgcaaaggcaatcgagaaccataatatcgaagtaatttaatgacaacctatccacctacattcttcctgacaaaaatcgttgatttgctctttttattttaacagatttcaaacagaaatcgacgtttaaagtcatcattaagggggatgttatgtagataaccccttatctgataagcattctcaatcatttttctgttgaaatgtggcagcaacatcattacaataagtaagaggaataggtgttaaattgattaaatataaagattgatccatttgttccaccaagaacaatctgggaggttttattcatggcaaagtacacaatcgtagacaaagatacatgtattgcatgcggcgcttgcggagctgctgcaccagacatttacgattacgatgatgaaggcatcgcgttcgtaacgcttgatgaaaacaaaggtgttgtcgaagttcctgaggtactggaagaagatatgattgacgcttttgaaggatgccctactgattccatcaaagtggcggatgagccatttgaaggcgacccgcttaaatttgaatagaagtaacaaaaaagctcccgaacgggagcttttttatttaatggatatgtgcacttcgctgctgctcaatccatggcttaagcttgataaaaattagtgaaaatacaaccgtaattacaataccttttatcatgttaaacggcaggatacctgcgacgactgctgtttttagcgcgctgtcggataatgccggtgaatgtaaaaaccacgtgtatgccggaaggatcagaacataatttaaaatactcattaaaatggtcatcgctgcagttcccaaaagcaggctgacagccaagccctttgctgagttgagttttttaaataagaaagcagtcggtaatataaagagtgttcctgcaataaaattcgcaacttgccctacaggaactccggccatgcttccctgaatgatatactgaagaacattttttatcgcttctacggcaatacccgccaaaggtccgtaaatcagaatggcaataatagcgggaacgtcgctaaaatcgatttttaaataatccggaagacccggaaacgggaaatttaacagcatcaaaacaaatgcaatgctgctcagcatgctgaccacaactaatttttttactttcacttcattctctccttttcgatcacatcttactcgaaaacggaaaggttcttttccagccaataaaaaaaccgcttcatatataaaagcggggtttcgaaaattaggctaggcaaagaaacgtttgaaaaattcaatttcaaaacgcttatgaacctccatcttctcccatccagactgtactgtcggctccggaatctcaccgaatcctgctgtaaagacagctcgcgggcttagagccattggctcatcaccgccggtagggaatttcaccctgccccgaagattgatcatatgaaatttaattacattataaacgataactggttggctgtatagagaattgcttcaaattaaatatattacctgcaagctatcagatcattgatttattaggctttacttttatcctttactgcgtcaatacacgttgacactcttttgagaatatgttaaattatcagatatttagtttgtcaatttaggaggaaatctaacgatgtttcgagtattggtctcagacaaaatgagcaacgacggtttacagccacttattgaatcagactttattgaaatcgttcaaaaaaacgtagcagatgcagaagatgaattacatacttttgatgctcttttggtgcgaagtgcgacaaaagtaacagaagacctttttaacaaaatgacttctttaaaaattgtcggaagagccggtgtcggtgtcgataatatcgatattgatgaggctacgaaacacggggtaatcgtgatcaatgctccgaacggcaacaccatttcgacagctgagcatacatttgcaatgatctcttctttaatgagacacattccgcaggctaatatctcagtgaaatccagagagtggaaccgcacagcttatgtcggttcagagctttatggaaaaacgcttggtattgtaggattaggccgaatcggaagtgaaattgcacagcgtgcaagagcattcggtatgactgtgcacgtttttgatcctttcttaacggaagaaagagcgaaaaaaatcggcgtaaacagccgtacatttgaagaagtgcttgaaagtgcggatatcattaccgttcacacgcctttaacaaaagaaacaaaaggcttattgaataaagaaacgattgcaaaaacgaaaaaaggtgttcgcttaattaactgtgcgcgaggcggaattatcgatgaagcagcacttctcgaagctttggaaagcgggcatgttgcgggagcagcgcttgacgttttcgaagttgaaccgccagttgacaacaaacttgttgatcatccattagtcattgccactcctcacttgggagcatcaacgaaagaagcacagctcaatgtcgccgcccaagtgtcagaagaagttctgcagttcgcaaaaggcctgcctgtcatgtcagctatcaacctgcctgccatgacaaaagatgaatttgctaaaattaagccctaccatcaaattgcaggaaaaattggcagccttgtatcacagtgcatgaaagaaccagtacaggatgttgccattcaatatgaaggcacaattgctaaacttgaaacatcgttcattacaaaagcccttctgtcaggctttttaaaaccgcgcgttgactctactgttaatgaggtcaatgccgggggtgtcgcaaaagaacgcggcatcagcttcagtgaaaaaatttcctcttctgaatctggatacgataactgcatcagcgtaaaagtgacaggagaccgcagcacctttactgtaacggctacgtatattcctcatttcggagaacgaattgtcgagatcaatggatttaatattgatttttatccgacaggtcacttggtgtatatccagcatcaagatacaacaggtgtcatcggccgagtaggacgtattctcgggataacgatattaacattgcaaccatgcaggttggccgtaaggaaaaaggcggagaagccatcatgatgctttcctttgacagacatctggaagataaaattgtgaaagaactaacaaatgtccctgatattgtgtctgtgaagctcattgatctgccataatcaaaaaaactcaagctatatagcttgagtttttttattgttctatcctcgtgtgtttttatgcaaaatatctaagacactccttagctcagaaacaggtatttgacctggtgcggacgcctcttctccagctccaaaagtacaagccgatccaaaaacctcaccgctcagcctgctgatgagccctgttgcagccattgacattgtaataatgggacggtctgcatattttgttttcattgtatatgtcgcatcaagcagcgttaggagatctccagtatcattcggcataacagccattttgggaatatgcgcccctaaatcctgcattttccgaagtcttgaaagaatctcatcttttgaaggtgttttttcaaagtcatgatttgacatcaccacatagacgttgttttcttccgccatcgatactaacgcttttacatgtgcatctcctgaaaataattcgatgtctatcagatcgatgtcttttgtttggattgccgattccagcaaagcaatataggagctttcgtccatctccatgctcccgccctctttgtgggttctgaatgtaaatagaaatagcttgtcttctaaagatttacgaagcttagaaatgagctttgtgaccgcttctctgtcattcgctttttcaaatacgtcgactctccattcaacaatgtccggattcagtaattttactgcttctgcttcattcagaatttgtttttccgtctttcccatcagcggaacgatgattttcggcattccttccccgatggaaactcctttaatcgttaacacgttcactcatctcaaatcctttcaatcgttaccttgttttattatacacgtacaacttttttttgaaaatttctattatatgaatagcaactaaaaaagagccttaaagggctctttttagtttaaggaaatcggatttggagcagctggcaccggaattgcatctgatatgtcatatttgccgatttttttcgttctggtttccgtaaaggtcacttctgtgaagccaaactcttttgcagtcaaaagtagtccctcaatcattaaaataccggcaatagaatcatcaacttctgactcctttgaaaagcggatatataagtgtttctgtttcttcgttacagattggacagcacccgcttgaataagaggtgtcgtatcttcttggctgctcgattccatttccttaatcgcttcttttactgtatcaaaagaatgatttgacggaacgagaaagtcttgtccttgtttattttggtacaagtagtaggatcgttttgactgtttgggaatcgaaatttccgtaaaagtgccatatgagccaatccgaaccccagtctcattttgatccgataaaaatttgactttttcataaggactccattttaaggattctttaagcaatttttttaacagtgtatcatcttttatagaaaatgccgtagctggctgatggactcgtatacttaattccttctgctttggtttttcctttatttctacttcatctatgaaggttggaattgtaatggcatgatcaaggatgcccaattcactactttcaaacagcatatcctggatcgtttggtctgcatttgttttttgaatgctgacgggtatgattgcagatgtatcggcatcagcaaccgctacagtgatgtaattgtcttgttccttttcaggaacgacaaacgatgtctgatccaaggatgatgcaacttttgggctgtcttctgtctcagttttcgttactgcgttctcttgggacgcttctttttgttgaggctgtgcctgatcaaagaaatgaggagaaataatgaaggcgatataaaccgcaattgcagcggcacacgcggggccaatccacctgacagcgggcttatttttacgctttgccatcgtcagccgcttgtaaatatcctgaggcgaacgatggtctttaactgccggaagttgacttaacaactcctttatctgttcttcgttccattctgacttcatcatccattagctcctccctcaaaagctccatatgtttccgaagtactttgagccctctgtgttgggtcgtttttactttgctttccgagaagcgcagagccttggctgtttcctgtattgaatatccctgaataaaccgcaagataatcacagctctttgatcgattgtacattgatcaagcgcagcataaatttcccggacattttcatgttgaaccgcaagttcgtccggcagcaattgctgatccctgacatcctgtgtatcccagtcaaatgtaccgagtatacgctgtctgattgtttgctgtttacggaaccagtctatcgcaacatggcgtgcgatagacaaaagccatgttttttcactgcttcttccttcaaacgtatgataagaatttaatacccggatataaacctcttgaagaaggtcttctgtctggtttttatcctttaccatataaaataaaaattggtacaaatcttgatgatatgtatcatataataattgaaaggtttcttccatttgaaacccctccgttcacttttttgtcgtatgaatagcttgaaaagttacattacaactatattacgagtaactggaatttggaagggaatttatattaacatatccttaaattttattaatgttggctattaaaaaaacacccgctcagtcagcgggtgtttcttatggaacaagattcttcggcaaattcagactcgattttaccgttttgtcggaatataaaaagtaaatgttgttcctttatctattcggctgtgcacagtaattgatccgttgtgggcttccacgatatttttaacgatagccagccctaacccggttcctgctctgccccttgtccgcgctttatctgccttataaaaccgctcaaagataaatggcagatcttcttccggtatgccggacccggagtctttgatatcaattttcaatccatccttcacagaatggactgaaatggagacactgccaccggatgaagtatgccgcaacgcgttatcgatcaaattggtaaatacctgctccatcttgtcttcatcaaacataaattcctcttctgtgagagaaatgtcatgatgtaaagcaatatttttttctttcgcaacaccggaaaacttccgaatgatcttttctaaaaactcattcacattgattttttcataatgtaagcctgtatggcctgattccattcgggctaaatcaagcaaatcattaactaaacggcccattcggagcgattcgtcataaatgatttgggcaatttctttccggtcttcttcagagcttgcaatgtcatcgacaattgcttcactgtatccctgaagcatggagatcggtgttctcagctcatgactgacatttgcgataaagtcctcccgcagcttatcaaggcggcgttcttctgtcatgtcacgcagtacggcaaccgctcctcttacgtgcgattccgcataaagcggcgacatcaaaagcacccatgatctgccttgcagcgtcatctcaatcatttgttctttttcagtgctgacagcgttttgaaacagctcttttgcttcaggcggaaggttgtcgccttctttgatattcatattctgttcataataccaagcctgaagaaaacgttcagccggcgggttggtcacaagaatcgtaccgtcaatattaatggtaataaccccgtcagccatactgctcaaaatgttagaaagctgctctttttcttgattgagcgcattgatatgaaagttaagctgccggcccatttgattaaaagcggtcgccagttcaccgatttcatcctgagttaaaatcgggatttttgtatcgaacttgcccttcgccaaatcctgcgcgccttctctcatttttcggagagggtacgtgaccctgcttgataaaaagaatgcgaaaaatgtggtcagcacaatcgcaattccagcggcaagaaaaatatagcgggtcgtatgttttgttgtatctttaacggcaagcaaagactgggataaaaagaccatgcctttctttccgtctttttcatacgggacacctacaatcaggcgttcattatccgtgtctgtatcgctcaatcccgtccgtttgcttacttttttatggtctttgagagctttatttaagtctttgtcatgctgtatttgctcaaccgtaatagacgacaggcaatttttatcattcggagaataccagtggttcttctcatcctggatgatggcaatgcttgttaagttatcagcgagctcccaagtgattgaccttgccagtgcctggtcctcgtgattttctaggatgacagcaactttattcgcaagctgtgttaaatcattctcggcttcttccacatggtagttttcaataaactccagcaaaagaaccgttaaaatgaacaatacgatcaagacgagtgaaaggatcgtaaaccacagcttgcctactacgcttttccaaaatttcattcagcgccgacctcaaatttataacctacaccccatacggtgacaatttttttcgcagcctccggagaaaccttgttcagcttctctctcaagcgtttgacgtgagtgtccactgtccgtaaatcaccaaaaaactcatattgccacacttctttcagaagcttttcccgatcatacaccttgtcaggcgttttcgctaagaaatatagaagctcatactcttttggcgtcaggctcacttctgttccatcagctgttacgcggtgagcatcatggtctatggacagatgtgaaaacacgagcacatttttcgtcggtgtattggcattgaaataagaggtttgggatgctcttctcaaaagggcctttacacgcagcacgacttctctcgggctgaacggcttaacaatataatcatctgttcccgcttcaaacccctgcacccggtttgcttcttctccttttgcggtcagcatgataatgggtgtcgcttttttttcacgaatttgccggcacacttcaattccatcagtccccggcatcatcagatcaagcaaaattaagtcataattggcttcaagccctttggcaatggcttcatcaccattttcagcttcatctatagcataattttcacgttcaagatacattcttaaaaggcggcgaattctggcttcgtcatcaactactaatatttttgtttcgttcgtttggtccatgttttccccctgctttccttctgttactttcattttatcaaatcgtgagaaagtttgagaactgtgtcgctttcaaaggactatgcataagaatgaagtccggcaagcacaagatttacgaatattaaattaaacataataatagcaaaaccgattacggccagccatgctgacttctcaccgtgccagcctcttgacagtcttaaatgcaagtaggcggcatagaacaaaaatgtgatcagcgcccatacttccttagggtcccagccccaaaatctggtccacgcgagctgagcccaaatcattgcaaagatcagcgcgccgagtgtaaagatcggaaatccgattgatacggccctgtacccaacctcatccaccagatcaagattgacgtttttcaccagcggatgtaatagagcgctgattctttttctgatgatcagacggagagccccatacaacacaagacctgctccaaatgaccaaatgacagtgttcacttttctgcctgagaaaagcgcgggaagatcaacaagcggttccattcttccttcggtcaaaagctctccctgatgcggaccgacaagcgcgggcatttcgtacaccatcacgcttttttctttatttttgtccacccagttaaactccgcttcatagcctgcaagacgaaatgctgatgtgattgcaataaaggcgacggttgtgaccaggataaacataatcgcttcaagccagaaggtctttttgcttggctttgtctggtctacatgcttcaaaagaaagatgacaccagcgacaaagctgatggcaagtatagcttgcccaagcgcggccgttgttacatgaatatacagccagttgctttggagcgaaggaattaaaggcgagatatctgttggaaacatgctggcgtaggcaatcagcaataaagcaattgacagcgtaaacagacctaatgaaggcaatctatagagaaaataaagaatgataaacgccaaaacaagcatcatgccaaaagcggtggtgaattcaaacatattgctgacaggcgcatggccgctggcagcccaccttgtgatgaaatatccaaggtggcagaaaaaaccgacaatagaaaaggtgattccaatgttggcccatcggtttggcctgccctttttatctttattcccgcgtatggccccgccgaagattgggacagcgattaaatacacaagaaaggccgcataaagaaaatttccgctcagctctgccatgacatcactcccttttcgcctatttctgtgttttgattaattctttttggtccaccggttcagtcagtccggaatcagccaatataaatgctaaatccttcttcaggccaaaccagtttttattggtatgccccgctaccataactgcgccatcctgtgagtgcagccaaattcttcgatgctgccagtacataccttgaatgacaccgatcataaaaatggctccgccgacagcaagcacccagagtgtcagatcctttctgactgtaagtccagtaatgtttttcgtttcgacatggtcaaatttcagcttgtatttattattgcctgatccttcgatggtttcttggatggcgacaaagctcttttcgcctttcggtttgtccggcgttataatattaaagacaaaagccggattgttagggatctttgtttttgtgctcggctctccgtcctgattaaaatagaagtcaggcaggtagctggcgatttccaccttgtaaccgttgccaagatcatagaccgaatctggatccagaaggttgatcttcaggctcccaaaggatttttttgtttttttatcaatcagctggaacaccatttggtcaagctgattctctttgtaatccacctggtaaacggaaaaagaatcaaaacgcagcggctgattgacacggatgtcttcttctgttacttttttcagcttcggcttctcgccataaacaatttttccttctctcttgtagagtacagcctcggtttgaaagttctttgccactctaccgtccccgactctgtcaatggcatctgcaaatacctttttttccgttttgctgttataggtctctacgctgaattgattgtttttcaaataatattttccgtctgtacccggaattgcggcggtttcgccttctctgacccaaagcgtctcatcgacgtacatgccaggcacaaatctcagcatcgcaccaatcaaaaagatgatcaatccaatatggttgacatacgggccccagcgggaaaagcgtcctttttcagcaagaatgctgccctctttttctctgattctataatgttttttctttaatagagcaactatcttttctttcgattccccgttcagtactgtaactgtttcactgaacaagcgctgccttcttaaaaaagccgggctccttctgacgccttggttttttaacgctctatacaacggaatgacccgatcaaggctgcaaatcacgagtgaaatgccgatcgaggcaatgagcagcaaataccaccaagaaccatataaatgatgaaacccgagcaaataataaagctggccgaacgtgccatactgctccttgtaataagtatcagcctgtgcgcccggaggcagataggcttcctggggaaaaatggtgccgaacgctgatgcggcaagggttatgacgataagccatattcccaccttaaccgaggaaaagaaattccaaattttgtcgataatcgttttgttataggtttgcgaacgtcttgcgcttccgtcatatctcatatcagcgagcggaggttgagtttcctgaagagctcttccgcacgattcgcataaaacggttccgaccgggtttatatgtccgcattcacatttgacttgcttcatcccgaagtctctccgggttttatgagattcatatattcgtgtatcatgctttctgtcatagtgccggtcaccaccttgacaacttttccttccggattgatcaaaaaggttgtcggaagcggagatacgtcataggcatcaagcacttggcgatctgtatccagaacaaccgggaaattgactccgtaggatttcataaaattatgtactgctatctttgactccccaacatttacagcgacaatttcaacaccttggcttttaaaatgcttatattggtttgccatataaggaaactcttttttgcacggttcacaccatgtaccccagaaattcaaaaaaacacctttcccttttaagtcactgagctcgatacgtttcccattcgtatcctcaaggacaaaattcggtgcgtcggacccttcggatatactctctttgccggcaaatacagcattgtaaatggtatagccgagtgcgcagattaaaacgagaaggatgccggtccgaatgaataaacgcctttttttcttcattgtccactgcccccttccccctattgcagatccattcaattatatcattgcacgttcatttcacatttcttactttttgaaggttatgtgaaatttagaaagcgtttttaccgtgatccgccagtgctctgagcctttttacttcgtggggcgtaagctctctggcatcgcccgtgtgcaggcctcgcaggtttaaaaacgcgtattcctcacgcttcagcttgattacctcatgtccgatcgcttcaaacatgcggcgcacctgtctgttgcgtccctcatggatcgtcagctgaataatgcttgtctgctttttcttatccaaggacagcagcttcgctttagcaggcgctgttttgccttcttccagcctaattccgcgctccagctttctgagcagctctttaggcgggattcctttcaccttcgccacgtatgttttgtctatttcatacttagggtgcatcagcttattggcgaattcaccgtcattggttaaaagcaaaagaccgctcgtatcatagtccagacgcccaatcggataaatgcgctgcggaatatttttaaaaaagtccgtcaccactttgcgtcctttatcatcttgcgctgcggaaataacacctcttggtttatataagagaaagtaaaccggctcttcgcgttcaacctttaacccgtttacctcaatctgatcagaactggtgaccttaacacctagctctgttactactttgccattcacctttacttttccttctttaatcagctcttctgcctttctgcgcgacgcaactccagcatgagcaatcactttttgcagtctttccatgtctttcacctcaagtattatcttacttttttcaaccttaacaaacaagctttttcaaattcctatgccatatctaaaaaaaacgccgttttcaggcgctcccaaataataacgtaacgatgatgatagatgcaactacgccgattaaatctgcaagaagtcccacctttaatgcatcacccatttttttaatgccgactgctccgaaatacacagtcagtacgtaaagcgttgtatctgtagatccctgcatgacggaagccagcctgccgataaaggaatcgggcccgtatactgcaattaaatcggtcgtcattccgagagcggccgtaccggagatcgggcggatcagagcaagcggcactacttcagcagggatgcctatagcggagaaagccggttttaaaagatccattataaaatcaagcgcgcctgatgatctgaaaacagttatagcgacaagcattccgactaaataggggataatggaaaaggcgatttctatcccctcttttccgccttcgacaaacgattcatatgtcggaacctttttgatcgttccataaagaagaattccggcaataatgattggaatcatggctaaagacagccagttgatgatttccatccgctcaccttcccttctttttgcggcggtaataaaaataccgatcaatgataatggcaccgattccggaaataagcgttgccaaaatgcttggcccgacgatatctgtcggcgttttggaggaataagccattcggacagcgatcaccgttgtcgggatgagtgtgatgcaggacgtattaacagctaaaaaagtaatcattgaccggcttgcttccgatcggtttccattcagctttttcatttgttccattgctttaatgccaagcggagttgctgcatttccgaggccgaagaaattcgccataagattagataaaatatagcccatcgccgggtgatccggcggtatatcagggaacagtttagatataaaaggcctgcacatccggctgaaaatatccaaaagacctgactgctcggcgattttcattaagccaagccagaaaacaagcacgctcatcaatccaaatgaaatcgtaatcgcttctttcgcacccttaaacacggcttcatttacatcttgcagagttccgttgcacatcgcaaaaacgagtccgatcacggttaaactgacccaaattatattgaccattttgctccgcctgccgcattcagaaagattgatttaaacgtttcaaaaaattgtttcttcggtttttgatgccgctcattttcataatagatcggcacttttgcgatggttgcattgttgaacatgatctccatgtgccctacgatgtcagggattttcgaggcatctttttcccatgcttttttcggcttgagcagtgtggtattaattttcacatcttctttttcctcttcagtcagcaaataggtgatatcacgtttgataaaagccttcgattcataaaatgtgcctttcagctttggaatatcccctttttttgcaattaaataggtttgataatgctcaaacacatagttaaacatcttcatatggtcatcccaatcattagggtcattaatggtgacggctatcaggtcaatgccgtcctttgaagccgtagagaccagtgtccgttttgcaagttttgtatagcctgtttttcctcctgtgctgtacggatatagcatggtcagcagtttatttttgtttttccatacgctttccatcgtttccgctttgtatatttttgtgcctgaaatcttttgatagtctttcagcttcatagcatatttagttaaaatggccatgtcataggctgttgaataatgattttcatggtcgtccaatccgtgcgggttttgaaaacgggtgttcttcataccaagctgctcggctttttgattcatcatataaacaaacccatcgaggctcccaccgacatgctcagcaatcgcgacagcggcgtcgtttcctgatcttagcatcaggccatacacaagatctttcagcttcactttttgaccttctgttaaataaatggcggagccttctgttctgacagcatttgccgaaaccgtcaccgtttgatccattttgccggattcgatggcgaggacggcggtcataatttttgtgatgctcgcgatccgccttttttgatgctcatccttggcatataacactctgcctgacgcatcgtcaataatgatcgcgctttttgcactgacatctatagcagcatgtgctgtattcacatttacggttgcaataagaaaagaaatcatgatcacgaatactgcttttttgaaaatgcgcatgtttgctcacgtccttgtggtggtttgtacaagtttatgcgcatgtccatcagttatgaataacaattatatttctggaagcaaacataaaaaaactctccctgaaaaagggagagtaaacgttatctgattggcgccatgcttgatccggacgcttcgtaatgagccagctcttccctcatcttcagaaaggccgcgctcaacggcaataataattgctcaagcgacgcaggaacagcatgataaaactcaattgcgctgaccccggtataagacgcccggctattttcacaccacgtgtcttttttcggcataaagaactcttcaatgcattggtgatacacattataaagtgttttttccgctctggcttcctgaaaaggctcctgcatcaggagacggcggcacgcttctgcgcctccttcacaaaatactgccattcttctcagagtgctcagcacatcacagcagtatcctttttcaataggcaattcagcctgtaaggactcaagcgtcgtttgatttaggtaatcgttcacggtattgacaaccattgataagaattcgcctgttttttgagtctgcgctcgcacaatcgaatgtcccatttcgtttggtatcttccctcatgtctttgtctctcacattttgcttctttcatgatagcttcttccttatatcttatgatgatgaaaaagcgcgattcattaaacttctattttatatcttcgaaggtttggttaaagttttcaaaaaataaatctgcttcttcttgaagaacgtcttcttccgcattttcaggcagcggcggaagctcgtccagcgttttcagaccgaattgttcaagaaaagtcggcgtagtaccgtataaaatggcccgccccggaccatcggcacgccctacttcacacaatagcgccttcgcgacaagactgtgtaaaatccgctctgattttactcctctgatttcttcaatttctgctctcgtaattggctgtttgtatgaaacaatggccagtacttctaaagatgcttgagaaaggccctttgacggcacttcaatcagttttttcaagtaaggcgcaaagtcttttttggtagagagcatgtacgtatctgcatactcaataagttcaatccctcgtgtatctccgcggtattcgtccgccacatccgccatgatagtgttcagttcaggctcttcgatttcaagcactgttaacagctgcttttttgtaagcccttcatcgcctgccgcataaagaagggcttccacaatagctttccaattcacgatatcaagccccatgaatggattcactccccgtaatgtaaatatctgaaaaattgtgctcctgttcaatgaggaccagctgatttttcatcagctcaagaacagctagaaaggtcactactaaatgttctttttgctcatatggaaacagatccataaagttgattctcgttcctttagatttcaagctgtgcacgatttcgttcattctggcttcgattggtatgtcctgtcttgtaattgttgtttccatcggcctgtttatttttttgcgtttcagcactttttgaaaagctccgatcatatcatagaccgtgacagagagcttttgctcagactgttttacttcttttgcatattcactcaaatcactcggcggtttcgtgaacgatttttgtctttcttcttcccgttcttttaaatccttcgccgcatctttatattttcgatactcaatcagcttttcaatcagttcctcccgcggatcttcttcttcaagtaattcatcttcaaaaagctcctcctcttgcttcgggagcagcattctgcttttaatgctgagcagcgtggcagccataaccaaatactcgctggccatatcgagctcaagcacacgcatcgtatgtacatataataaatattgttcagtgatcttcgccacaggtatatcatatatgtcaatttcaagacgattgattaaatgaagcagcaggtccaatgggccctcaaacgtatcaattttcacttgatattcttccatcatctcaccattttcaagtatcactctcattgccggaaaaactggctaccctatagtataagccaccaaaaagctctcgtccaatactatttcatttcctgttttgaacaagtttgtacagaatattcaaaacacgagaggtgtttgctcggagcgcagaagcgggagaaaaagccttagcttctggttttcctttctaagaagcaatagaggccgagcgttcttttttccttttatcccttctatggtacactaaaagcacattaaaggaggaagcaccttgtatccgaaagcttatatagattatctcgttgagtttcacgcgacacgggattattttgaatgccatgaaatattagaagaatattggaaggaagatccgccaaagaaacgaaaacgctattgggtcggctttattcagcttgcagttgctttatatcatcacagaaggcagaatacagccggggcaaaaagactgatggcaaacagcatccggattcttcaagcagaataccgggcagtcgaagacttagggctcgatcatggccgtttgctcgaacttatgcaatcggtttacgaacaaatcgaaacgggctctgcctataaaagcattatgctgccaatcaaagatgagaaactggaggaagcatgcaggatcgaatgcaggaaaaaaaagtatacatgggggcagcccagtgcactcaggaacatatttcttatcgacaaacaccgtttgcgggatcggactgacgtcatccgtgaacgtgaaaaagaaatagaacgcagaaaaaaaagcagagactgatcacagcctctgctcagcgtgtcgacaaaccctcgcattcgttgtcaagcctgtgcgttggtgctcacgaatgaaaacattcgctccgctccaatgctcagctttcctagacttcaagggttttcaatcgcgctgaaaggatgacaaaaacctaaaacaaaactgttttcggattttgtcatcaaactaaagcagaggctgatcacagcctctgcttaattattgtatgaaatgtcttgatcctgctgaccttgacaacgttcgaaaaagctctgcgttaattcatttggaaccagtacttgcgttttgaataaatgctttaaagcatccatcatctgttttccgattccttgatggcgatgagaaggattcacactgatatgccggatctcaacctcagaatcctttttttcgactccgattgctccgacgatatcctcgtcctctttccaaagaaagagctggcggtctgtatccgtttcgtagtccttaattgtctgctgaagctgcttaaggtctttttcattcggcataaacgaaagaagccccatcgcaatcttttcaaacgattttttataacgaattaacataaaaacccctctatatccaaaatgtccagtctgctattaacggatacgaataggtgatccgttttctcacattatatcattttcgccatatttttaaactgttttcagcaaattattcaaatgagcggtttaaatttgccatttcaatggcagaaacagcacaatctacacctttgttgcccgcttttgtgccggcacgctcgatagcctgttcgatgttttcagttgttacaattccaaagatgacaggtacaccagtagtgtttgctgcttgcgcgatgccttttgcagcttcattgcagacataatcgtaatgtgtcgtcgcgcctctgatgacagtgcccaatgtgataatagcatcatatttttttgtttccgccatttttttcgcagcaaacggtatttcaaatgcgcctggaacccaagccacatcaatatcatttgtgtctacgccatgtctgagcagcgcatcttctgctccgctcagcagcttgctcgtaataaaatcattaaatcttcctactacgattccgattttaagacctgtaccaactaaatttccttgtatgatattcatatgattcccatccttttttgtgatatttgtgattagaaatgaagtaaatgacctagcttgttcattttggtttgcaaatattttttattgtgttctttcgcctccatttgaagcggcactctttctgaaatactgagtccgtagccttcaaggcctgcgatttttcgcggattattcgtcaaaagcttcatattccggacaccgaggtcgcgtaaaatttgtgctccgatgccatagttgcgaagatccggcaagaatccaagcgcctcattggcttctacggtgtcataaccttgttcctgaagcttataagcttttaatttattgattaaaccgatgcctcgtccttcttggcgcaagtacagaagcactccacggccttcagcggcaatttggttcagcgcggcgtgcagctgcggtccgcagtcacagcgatgagacccaaacacgtcacctgtgagacattctgaatgcacccggaccaataccggttcttctccgaacggcacctctcccatcacaaatgcgacatgctcttttccatctacctcatttgtgtatccataaaccttaaatgtcccaaaatcagtaggcagcgtaatgtcaacttcacgctcgacaagtgttgtcagattgtaacggtattgaatcaaatccttaatggtgatcatttttaattgatgctttttcgcaatttcaatgagctcaggcactctcgccatcgttccgtcttcattcataatttcacaaatgacgccggctcctggagatccgcaagcttcagcaagatcaacagcagcttctgtatggcccgctcttttcaggacacctccttttttcgcaatcagtggaaaaatgtgccccggacgctgaaaatcagatggcacggatttgctgtccagcaatgcttgaacggtaaaagatctttcttgagcgctgatacctgtcttcgtttcacgatggtctatgcttacggtaaatgcagtgtggtgagaatctgtattatgctcaaccatagggtgaagatcaagcctgtctgcgatttcctcactgagcggcgtgcagatcagtcctctcccatgtgtcgccataaagttaatgacttccggcgttgcatgctcggcaagagccacaaagtctccttcattttctctgtcttcatcatctacaacgatgatgacttcgcctttttttaaagcgtccagtgcttcttctatcggatgaaacatgcaaatcttcctctctaaaagccgttttcgcttaagaaggcttttgtaatggtttgttgggtcttattttcattggctttatgcaaaaatcgatacatatattttccgatcatatcgcattcgatattcactttagagccgatcgttttttctgaaaaaatcgtttcgctgatcgtatgcggtattaaggagatcgtcactgtgtcttctgtcaggccgaatatggttaagctcacgccatccacagtaattgatccctttaaaaccaatgtttttgttaatgacgggtccatttttaaatcatagtaaactgcgttgcttttctcttcaattcgtgtgatttccgcagttccgtcgacatggcctgagacgaaatggcctccgaaacggccgtttgccgccatcgctctttccagatttactttgcttccttttgttaaatcattcagtgacgtagctttgactgtttcaggcataacatccactgtgaattgattttttgtaaaatcagtgacagtcaaacaaatgccgttcactgcaatgctgtcgccaagatgaacatcctctaaaatctttgagcatttaatagttaaggccattgaatgccctgcttttttcatggattcgattgtgcctgtttcttcgataattcctgtaaacatggtcaccatcctattcctttgtcggttttgccgtcagtttgatatcacggccgatttgggttatatcagtgaattgtaataaggggacatctttcattgattgaaaaccttcaccggagattaagctgggagcatgcgttcctccgattagtttaggggcaaaatagaagatgatttcttgaaaacagccttctttgacaaagcttccgtgaacagctgaaccgccttccacatacaccgacatgataccttcttccgctaggatcttcaaaacatcgggaatttgaatgcgctcggtttcaagtgtaaatatgttcactccgaaagctgaaagccgttttttcttttcctcttctgcgcgtgccgtcgtaaaaatccatgtcggcgctatttgatcacaaatcactttagcgtcctcaggaatcgagagtacggtatcaagtatgacccgaaccggctgttttgttacattcggcagtctgcaggttaagctcggattgtcggctttcactgtgccaactccgactaaaatgctttggtgtgttttcctgtattgctgagcatcctgtcttgcagcctctgacgtgatccatttgctgtcacccgtgctggtagctatcttgccgtcaaggctggcagccgcttttagcgtgacgtacggaaggcctgtcctcataaagtgcagaaatttttcattcagcctctccgcctggtctgccaggataccttcccttacctcaatgccggcttctttgatcatgctgatccctcttccagccacaagcggattaggatctctcatcgccacgaacactcttttgatgccagagttgataatcaattctgcacatggcggtgtttttccgtaatggctgcacggttcgagtgtaacgtaaatgtcggcaccctctgcatgtgctccagccatatggatggcatgaacttctgcatgagcctcaccatattttaaatgggcgcccattccgacaatttgtccgtcctttacgacaacagcgccgacgagcggattggattcggtctgtccttcgccctgcttcgcaagatctaatgccagcttcatataatactcttccatttgtttccctcccctcttttgttatttaccgtcaaaaaagccccgaatttataaaaaattcggggctttaggtattttacgcaataggaaataacactatgcatttttgaaccatttgcatagcggttcatcatccttctcccatccagactttcactgtcggcttcagcttaaactgaatccaccgcgtgcttatgcacacgggtcacgggctctaaagcaaatgtgctttactaccgccggtcgggatttccaccctgccccgaaggatacaatctttattcatttgtccttattggctattatagcgatcctttttaaagtacgcaatgaaataaacttacaatttgagaaaaacaaaacatcacccttcgatccgaaaggtgatgttttgttaatcattcacttttgcaaccttgattaatccgtcgatccgctttgatttgctgaagtatgccttaatcttgtcaccttcttttatatcagataaatcctgatttaatttttttccgttgaagatgattttcgttccgttttctgctactccatgatactctgagccgtcaattttcgtcactttatattcctggatggtgtattcctcttcttccgaggacaaggtttgtccaattgctgtcggaacatccttcagctcaacatcatttatgtacatataaccgcctgcaagtaaaagcaaaagcactaacagaatggtaatcttggtttttattcttcccatttctaaacctccagccaatatgaatctattcattcatatgagttattcctttttttcatgaataaaaaaccgtaaattctcgtaaattattaatataacgatgcataacgggaatatgtttcacatttctgcaaaaatttcttttctatagatatacgaatttatgttctgtttttaggggatgaccgtaaaaaagatataaaaaaagcagccccaatgggaaactgcttgatcctaatttgttttgcgcatttcgttaaacgggtagaaaacaaactttgacgtacccgcaatttgttttttcgtgaagaggccaagaccgttacggctgtccattgaattccgacggttgtcgcccatcacaaaatacttgttatcaggcactttaaccgggccgaaatcatcggtcaaatggtcaaaaccgtcctgtttcgctctctttttattagccgccaaataaggttcgtccacctttttcccgttgatatagagctggtcatttttcatctcaaccgtatcgccgggaaggccgataatacgtttgacatagtgaacatcatctccgtttaacacgacgatgtctcctctatcaaactcgccgatgtatttgactgtcatattgacaaagaccctttcacggttgtgaagtgtaggatacatagagtcaccatcaacgacatacggcgcaaaaataaagttgcgaatgagcaaagcaagaacgacagcaatcacaattgcttttgcccattctaatattgtttttttcttcgaaacattttctgatttcaactgatttcctccaataaacaacggtcttcaatttatgttatcacgaatcgaaaaaaaatcccattaggaccattgaagtgattttacaaactgttaatcttcatcttctacccacatcatgcctaactaagcctgcaaatattgaaggaaatgaatcgcataattcagaagcgatggactcagaagaaagagagttctcatatgcaaaatctttaaatcgtatataaggcatgaggttacgaacagtttgttcatttactgcattccattgatctcccagtccatgatacccatggcacttgacaaaacaattcacgtcatgaaggttactggaatgtttgcggcaacctatttcacaggtgataaccgcactccgttttttgctttcataatatgtttaaaatcattgaagctcgaaaacatggatcagcctccaaaaaataaatccaatatattcccggcagttgaagactctttattataaaactctgaatatccgcagttcttacagtaaaccactagaaatcggttatgctgcacgtcaaacagctttgataatcccgtgccggttgtagctatttctttttgtccggcttcagtactgccgcattttatacagcctttgttgttcatatcgcgatctccttttcattacatcacgtttgtttgatttattttactacaaaatatcaatcccaatgacccgtactactttaaagtttacttaattttgattacatactaattgggttcgtttctcagcttggtaaatcttctggagaaacggaaaagctccatgaccaaaacattcaaactcagccaaacaccgccgaaggcgtaacccgcagcaacatcactcggatactgctcattaaagtacacacgactcagcccgatgaggaataaaacgataataaacaaaaaaatgcaacagtttgcagacgcgtcttgtgagaatgacgaacaaaaagataagcacaaaaaccaaaaatgacaaatgccgttaaagtctgttcgctcgggaatggatataatacatgactttccaaaggagcgtgaataggatgaagggaatgaaagagccgtctaattccctcttcataaagctctcgcaccaacgactaggagaaagagaggagaaagagagttcgattttccggtcttgccctttgaataccgtccaaaaaaaagttagaacaataacggctaacagaacacctctcgacgcaaaagctttctgaattgcagctgggcccagtctatacccgatccaatacgacatgcttactcccgcacagctccccaatccggccgctaacatgcttagcacccagtttaacttttcttgaaacacgagaacaccggcaaactctcccggtccaagtaaagctagaagctctaacatcaagacaataaacaagacggcatatccgtactgttcgagcaaccccgtcaaaacttgcatgtgattctccttaaacttttttgttcttttatcattcccaatccactttttgtataatcagcacaatttcaccttcagtcgtccaacaacattgtctatggcgggatcttctctcctatactcgtcactcatacattcttttttgacaaggaggagcaacagcatgaaatgggaagaaacaaaaaatacgcagggagtttgccaaaattttgggcagttcgttctgccaccgagtcaggtgtttgtttgcctacctcattccttggccattccccatttttcccgtttgaggttcgcaatgataaagtatttcacttagtttcgtacataaagaggtaaattctttgctctccgaactaggatgcggcgtatgacgattactgcattgcataaccactggttatttagtgagctgtgtgcaatgtatatgcactttgagtcagcacaggatgatcctattacattcgccagaaaagcagctgccgcattcagagtagttaaaagaatagacaggtagctgggcttccggaagctataaaggaggcgcttttttcgagcatttttataaatcaataaaaacaggcatctcctaaatatttttgccgataagtttacgctaatcaactctagcactaatacatataaaaaatagaatgatatgaaaggagacttgatagtatgattgattatcctattaatataaacaacgtttccgggaacagtgtaattaacgtaggcggcgcttttatgatcaggcctttaactttgtccaaatctgtgtttggctccggaggtttaaacacaggaattgtctttgaaaataactttgtaagcaaggctaaaatgattaatcatcaatttactgatcagaacgtcaccaaaactttttaatctattcattacgggggcttgcgatgtctcactaactaaacacctggttttgccaaccgccatcaacactgggcggttttttattgaatattttcacccaataaaaaagctccctctataagaggaagccttttgcctgctgattagccttctacacgaacttctttcatgacatcgccgttagacatgtttttcgcgaattccaatccgcttgttactttaccaaatacagtgtgaacaccgttcaaatgaggctgtggctcatgaacgatgaaaaattggctgccgccagtgtcttttccggcatgtgccatagaaagtgcgcccgcctcatgtgtatgcgggttgccttctgtttcacatttgattgtgtatcccggaccaccagtaccagttccgtgcgggcatccgccttggctgacgaagccagggatcactcggtggaacgtaagcccgtcataaaagccttcgttcgcaagcttttcaaagtttgcaacagttccaggtgcagcttcaggataaagttcaaattcaattttgttcccgtcttctaataaaaagtaacctgttttcaattgtatgcctactttctttattttaattttcaaaggagattatgtatgataggttatagcctgtctctccttgtcgcggctattataccacacctttcgggggaaaacgaatctcccgggctttactaaaaaataaaaatgaaacctgaatctctttatctccgtctaacctaacggaactgtatttttcatgattcaggtcctcacaaagcagcactatccagctgcttgtgaaattgaaggaggtcaaactgctttgaagaaaatttggattggaatgctggcagcggccgttttgctgctgacggttccgaaggtcagtctcgcggatgccgcagttggagatgtcattgtaacactgggtgctgatttgtcagaatccgacaaacaaaaagtgcttgatgaaatgaatgtccctgataatgccacaacggtaaccgtgaccaataaggaagaacatgaatatttaggaaaatatatatcaaacgcgcaaatcggatcgagagcgatttcttcatcctcaatcaccattgccaaaaaaggctccggattgaatgttgagacccataatatcagcggcatcacggatgaaatgtacctgaatgcactgatgacagccggtgttaaagatgcgaaggtgtacgttacagcgccgtttgaagtatccgggactgcggctttaactggattgattaaggcgtatgaagtttcttctgacgaagcgatctcggaggatgttaagcaggtcgccaaccaagagcttgtcacgacatcagagcttggagacaaaatcggtaacgaaaatgcggcagccctgattgcaaaaatcaaagaagagtttgctaaaaacggggtgcctgataataaagctgacatcgaaaaacaagtggacgacgcagcttctgatttaaacgtcacacttactgacagccaaaagaaccagcttgtctccctattcaataagatgaaaaacgctgacattgactggggacaggtcagtgaccagctagataaagcaaaagataagattacgaaattcatagaatcagatgaaggcaaaaacttcatccagaaagtcattgatttcttcgtatctatctggaatgcgattgtatctatattcaaataagaaaagcgccgaaaaatcggcgctttcttttattgctttacacccgttttaaatggcagatcaagttttacaatatcttcgtatgtttctcgcttcacgactaaatgagcctcaccgttttcgacaaatacaacggcgggtctcggaatacggttataattgttggacatgctgtatccataagcgcctgtacaaaaaacggcaagaagatcgccttcttttacttccggcaggtcaatatcccaaatcagcatatctccgctttcacagcactttccggcaattgataccgttttgtcatgcgcttctccgatcctgttggctgccgcagcttcatatttagcttggtaaagcgcaggacgaatattgtcgttcatgcctccgtctactgccacatactggcggacacccggcacttctttttgagagccaaccgtataaagagttgtgcctgcgtctcccacaagagaacggcccggttcgatccaaatttccgggatatcaaaaccgtaacgggaagcattttctttcacagctccgataattttttcaacgtattcagtggcatgaagcggttcatcatcttccgtataacgaatgccgaaacctcctccaagattcagcaccttggatacaaatgaatatgaatctctccactcgtctagttttttgaagattttttccgctgctaacacaaaaccggccgtatcaaagatttgcgatccgatatggcaatggacacccagcagctgaatgtgttccgattgtaatacttgttcgatggcccgttcagtttgtccgttatgaaggtcgaaaccaaactttgaatcttcctggcccgttgtaatgtagtcatgcgtatgcgcttctactccgggcgtgatccgaagaagaacatcgatggagtgacccgtttctttacataggtcttcaagaagcgcaatttcatagaaattatccaccacaatgcagccgatgcggtgctcaagcgccatgcgcagttcttccctgctcttattgtttccatgaaagtggatgcgttctgccggaaagcctgccgcaacagccgtatatagctctcctccggatacgacatctaaagaaagtccctcttcctcagcgagctgaatcattgcgactgatgagaatgctttgctcgcatatgccacctgtgctttcagccctgcagaaataaacgcctgtttaaagcttttagcacgctcacgtattaaagccacatcatatacgtaaagaggtgtaccatatttctccgctaaatagagagcatccacacctccgatttctaaatgaccatgttgattttgtctgcttgtgccgtgtaagaacaatgtcattccctctttctccgcttatggatgaaaggacagttttatggactgtcccttcataattaagacatacattatcatactcttcagtcagtttcaatgcgattatgaattggtaggctgtcttaagcgatttttggggtgaacgatactgggtcttacttttgcgccaggtttcgctgtgcggacaagaacctgccacagcgcctttccgttaaagggaatcagcggccataagtacggtgtctgaagggatttgatgcttgccatagcaataattagcactgtaaatccgatgacgagcccttttatatgaaataaggcaacgagtatcatgaggacaagacggctcattttgtttgccaagcttaattcataactaggcgtcgtaaaggttccaatcgccgcaagtgagacgtacagaatcacctcaggagaaaaaaggccgacctcaatcgcaatctgcccgatcagaacagcggcaattaaacccattgctgtcgataaagccgtcggtgtgtgaatggcagccattctgagaaactcgattcctaagtcagctaaaaatatctgcaggatgatcgggatatgcgtatctttatttaaaccgataaatttcatgttgtccgggagcagatcaggctgaagcacaaagagaaaccagatcggaagaaataaagtagaagcaagaataccgaaaaatcttacccatcttaaaaaggtcccgactgaaggagcctgcctatattcttcagcatgctgcacatggtgaaataaagtcgttggggtaatgattacactcggcgatgtgtccactataatgataacatggccttctagaacatgatttgcggccacatccggtctttctgtatagcgcacgagcggaaaaggattatagctttgattaacaatgaattcctcgacagttttgtctgccattgttaatccatcgacatcaatggatgcaatttctttttctacgatctcaaccagatccggatcagctatatcttctatataacaaatgcttaaatccgtctttgaccgctcaccaactttcgtcatcttgactcgaaggcgttcgtctctgatccgccttctgagaagggccgtattgacgacgatattttcaacaaatccgtctctggctcccctgactaccttttccgtatcaggttcttccgggtttctgcccggatagcttctgacgtcaattataaatgcgaaacctgcaccttcaacaatgacagcgacgagcccggacagcacttggtcggtggtttcatccaatgtttttactttttcgacctgggcgttcagcagcctgttttcgacgatgtcgaccagctcatcagggtcttctttccgattgttaatggcaacaagctctctcattaaatgaataatataggctgtatcgcataatccatttagatagtaaagctggatctctttatctaaaatcgtgagcttgcgaacacctacatcatagctcgtccccatcccaacacggtttttgaaatactcttcatttttagctggattccgataaacccgaattttctcttccttgtggtccggcatgatacccgctcctttctaaaataaactcgaccgctttcatggtgattggcgacccttttgagatatcgtcttttctgcccattttgccgatatccccgataccgacaataagcgggagatcaagtttatcaaggcaatagactgtatctccactcattctgtggtcatcaaattccctttccccgactttatcgacgccgtattcagttatttctccattgcggtcaatgcttacatcgaccctggtccattcagcctgatgtgtttttgacgcgaccgcaatcacaccgagcacttcaatagacggatgggttgcgacataggtcagagcggcttctcccggaccctctccttgaaggccggagtcgtcaaacatgacaaatacaggatcatacggtgctgaggcgatcagcttgacaagctcggcgccgctgcgggtggaaggattcccttttgattgtgaaatacatcgacctcccactttgcttgcggcgtattcaattgttttagcggcataaacatccccgtctgttaccagtatgaccttgcgttttgtcgtcatgtcagcattatcctttcggtttgaaaataacagctacgataaaggcgaaaagaatagcggctgagataccggccgaggtcagctcaaaaatccccatgccgattcctataaatccgtgtatatgcgcctgatgcatagcaccgtgcagaagactgtgaccgaagctgacgatcggaacggtggcgcctcctccggcaaattcaataaatttatcgtaaatgccgaaaccatctaatattgcaccgattacaacaaatgatgtcatgacatgagctggcgtcaatttaaaaatatccaagagcagctggccgacgatacaaatggccccgccgcatacaaaagccaaaaggtagtccatgttaagatgcacctcctgcacgctcaaatacaaccccgtgggcgatagtcggaatggtttctttttgctggatcatcgtcgggcttaacagcgccccggtcgccacgacaaatacacggtttaattttccttctctcagctgcttaaaaatatgagagtaggtgacaaccgctgaacaagcacagccactcccccggcaaagacctgctgatccggagtgtaaatcagaagcccgcaatcatcatgctttgtgccgactggatatccatcttcttttaagatgtcttttacgattggagaaccgacgcctgacaggtcacctgtcaggattagatcataatcatccgctgtccggttgagatctttaaagtgctgcttaatcgtatcagctgcagccggagccatagccgatcccatatcaaaaggatctgtaattcctaaatcagaaacctttccgacagtcgcacttgtgatttggatatcacccggtgtctgactgatgacaactgcaccgcttccggttacagtggaggtagcagtgtccggtttttgccctccgtattctgtcggatagcgaaactgtctttccgcagttgcattgtgactgcttgtggcagccagtgcccttttggcaaacccgccatcaactaaggctgatgcgacagccactgtttccattgatgttgaacaggcgccaaacatacaaagaaatgggattttcaagtgtcttgccacatagttagccgtcacgttttggttcagcaagtcgcctgcgagcaataggtcaatatcatcttttgtcagattgtttttttgaagcgcaacattaacagcgtcttccatgagctgccgttccgccatttcccagcttttttgattacaatgcatttcgtcataggttttatcaaataaagagccgagcggtccgtctttttcctttggtcctgctgccgttcccgctgagttgacaaatatgggatgttcaaatacccaggtttgctttcctgttaatttcattttcttctcctcctatgacatcagtttctcaaaagcaaaccgaatcattccaacgatgtatgcagctacaactccgaaaacaataacatttcctgccagtttaaacatatttgtcgctactccaagcactaatccttcacttttatattcaagagccgcgcttgccatactgttggcaaaacctgtgacaggtacggctgaacctgcgcctgcgaattgtccgattctgtcatagatgccgaaccctgtaagcagggcggaaattaatatcagcgttgcagctgttggattccccgcagttttttcattgaaatcaaaaaaatggatataaaaattttgcagaccttgcccgattgcacaaatcagtccgcccactaaaaaggcttttacacagttccagacgtaaggcggcttaggctgatatgttttcacttttgatttgtaattttcttttatgtttgtcatcttgaaacctccttatgaatggtcaataaagtacagccaatgaaataaggatcccgcgattttcccaatcacgatggccattaacagaataatgattttacttctgagcccgattcgttttgccaaaattggcaggacatttaaaacctctgtaagagcagccgctagcatcccgacgaacaaacctgccagaagcccgaccggcacagctatccattttgttagataaagatgattcatatgaagcgtctcccatcccccgcaaaccgcgccaagaataacagccgcttcataagcctgaacaaatctcattgttttggtgagctgcatcagccgcggaatgattcccattacggttaaaaaagcaacgaaacccgcccccactgttatgcctccgccgagcccgacaaaaataatgaacaatacactaacgatcatgcagatcctttatggtttcttgattctcatgcatggccacatattgatcgagatcaagctgatagttaaacatctcaacctccagcgggctgggctcttcatttaggcgctttttaaatatgtggttaaaaaacacgatcatccccagtcccaaaccgatgctgtatgggatttgaagcaaatatggatagtcattcctctctccggttatgatttcatatagtgcgatatgaacatctctcatgcttacatcctcatgaaagttcatgatggcaagacacgatccaataaacagaagcagccagacaccgataaatagaaccgttgataaatttcgctttcgatattgaatttcaacaatggtttctgctccgcctacggtttgaacatcaagtgtcggatcttgtaaatgaatggctctgaggacttgtatgatatccagaattacgatatttttatctttttcgctcacctgataaagcggcatagccgaaagtttctttttcagctgaagctgcccttctatttgcgcggcatctccaacggtaataatatcccctggatgtgccagcacccggtggcgaagccggataaatattcgtcgttccatcattgatcaccatctttcggtggttatatatgtagtatgtggttcgattttgttctcattcatccgctcgaaaagaccataaattaccacgcttttgcacataaaaaagctagcctgcactgcagactagccatccgtatgatccatttgaaccttgatctgttttaatattttcttttcaagcctggaaacctgcacctgagagatcccgagccgctcagccacctcagactgtgtctggtctttataatatctgagatagacgattaatttttccctttcctccaaatcgctgatcgcttctttcagcacaattttgtcaaaccatttttcttctgagttgtcagcgatttgatcgagcagggtaatcggatctccgtcattttcataaacggtttcgtgaatcgaagatggagcccttaccgcctcttgggccagtacaacatcctcagcttcaatctccaaatggtcagcgatctcctgcaccgtcggcactcttcccagtgttttcgaaagctcatccttcgcgcgccggattttgtttccaagctcttttaatgaccgtgatacctttacagttccgtcatcacggataaatcgctggatttctccgataatcatcggcactgcatacgttgaaaaacgcacatcataggttaaatcaaatttgtcaacagattttaacagcccgatgcagccgatctggaagagatcgtcaggctcatatcctctgtttaaaaaccgctgtacgacagaccaaacaagacgcatgtttttttctatgaggaggtctcttgcctgctggtcgccattttggctttgtttgattaattcctttacttcatgatccttcagctgagcgtttttgccgtttttcttaacctccacatccataacaaatctccttaattacaaagcgctttgctttttgataagtgctttgttaagcgaatcgttgttcccatttcaggcgatgaatcgatactgacatcatccatgaaattttccataatggtaaagcccattccagagcgctcaagctcaggcttagtcgtaaatagaggctgacgggcttcttcaagatctgtaatgcctaagccttcatcacgaatagtcatatatacgacatgatcttccagcgtcactgaaatgtaaactttcccttcacagttctcttcatatccatggataattgcatttgtgactgcctctgacacgactgttttgatttcagtcagttcatccattgtcgggtccagctgagctataaatgaagcaactgtcacacgggcgaacgattcattctgactgagggcagaaaactcaatgtgcatttcatttttcatgatgccacccccagtgtcaggagcgcctgctgttcagattgttcaaatcggataattttaaacagacccgacatatcaaacaatcgcttcaccgcaggagagatagcgcaaacgaccatttccccgccaatttgcttaatttgcttgtatcttcctaaaataacgccaagccccgagctgtccataaaggaaagatcctccaagttcagcacgatatggcgaatatcatccttctccaatgattgagtcactttttgcttcagggtttcagccgtatggtgatcgagttcgcctgttaatcgaatacaaagcacagattctttgacattcatgtcaattccaaggctcatgctcattcctccttgatatgatcggataatgagtgtttcgatttcgacggaatgaattccttcaccgtgacaaaactagtggtcattcggcataattacttaaattttgtccagtctcccatcgtccgcttcaagaatgtgataaacccggctttcttcatatcttcttttgcagcaacaggactttcagcgagtacttctccatcctttttcagaactagagtgccaagctcttggcctttttgaatcggagcactaatattgtccttcatcttgatttcttttttcacatcgttcatatcctcgccttttttcgtcaatattgaaatcggctcagatgtagagagttcgatcaatttttgtttcccttttttgacctttacttttgctactgtttcatttcgtttatataaaggatgcgtttcatactggctaaaggcgaagtcaagcatttttgtcacttgcgcgtttctttctttaggcgtgctcgctccgaatacaaccgctatggcccgcatgtttcctttttttgccgaagcagtcagacaatatttcgcttcgcctgtatagcctgtttttacaccgtctacaccaggataaaatttgataaggcgatttgtattcacaagccaaaactttttatctgtattttcacgaaggtaatcttcatacgtgccggtaaacttcgtaattgattcgtatttcaataattccttagccatgattgccatgtcataagcagagctgtaatgtccttcctcggtcaatccggtcgggtttttgaaggatgtatttttcaatcccagctcttttgcttttttgttcattttctgaacaaattcttcttcagagccggaaataaattcagccatggctacagaagcgtcatttcccgaagcgattgcgatacccttcagcatttctttgacagtcatttcttcgccaggctcaaggaagatctgtgagccgcccattgacgccgcatgctcgcttgtacggaccttatcactcattttgattttgcctttatctaaagcttccataatcaaaagcatcgtcataattttcgtcatgcttgcaggcgccagtctctcattgctgttcttgttgtaaagcacttttcccgtgtcacgttctatcagcaccgcagacttcgcttcatgagcaagctccgataaacgttttccgtcttgttttgcaaatgcagacggtgcaaatgtaagcagcattataccaatcaacaaagtggataaaagacgtttcatctcaaaagccctccatttcataatcctttttattttttccaagcgggatggttttatacgccactgatggaaaatgtttcgaattttgggcataaaaaaagacagctgtgtgatatcagacacagctgtcttttggtcctgcattgattcatatttattcgtactgagcgacgatcgctttaacaagcttcaagaatccagcttttactttttcggtcacttccataacttcatcgtgacttaaaggctgatccagaattccggctgccgcgttagagatgcaggaaatgccaagaacccgcattcccgcatgattcgccacaatgacttccggaacagtagacatgccgacagcatcagagcccatcgttcttaagaaacggacttctgccggtgtttcgtaagaaggtcctgtcacagcagtgtacacgcctttttgaattgggatattaaggtctctcgcaatcttttcagccaggctggacagatctttgtcataggctgaagacatatctggaaatctggcgccgaaatcagcttcgtttggcccgattaacgggtttgttcccataaagttgatatgatcggtaataatcattaagtctcccgcacgaaattcagtattgacgccgcctgcggcatttgtcacgatcaacgcttccacaccgagcgctttcatcacgcgtacagggaatgtgactttctccattgagtagccttcataaaaatgaaagcggccctgcattgcaatgacggaaactccttcaagagtgccaagcacaagctgtccggcatgcccttcaacagtagataccgggaattcaggtatgtcttcatatttcagcttgaccggattttcgatttcgtcagccaaaatgccaagacctgagcctaaaataaggccgatcttcggagattccggcaggttttgtttaataaaagctgctgcgcgttcaattctgtccttcaagaaacagtccccctattgtaataaagataaaaagcttttcccgtatttcggtttattcgtttggaaattatcagcgatcgttgcgccgatatcagcaaatgtatctgcaagcggcagcatttgcgctttcttatgttttttgctgtaagcgagaatcggcacatactcgcgtgtatggtcagtcccatgatgaatcggatcattgccgtggtcggctgtaataattaacagatcgtcttctctcattttttcaaacacttccggaagccgcgcatcaaattcttcaagcgcgcgtccgtagccttcagggtcacggcggtgtccgaataacgcgtcaaaatcaacaaggttcgcaaagctcagacccgtaaagtcttctcccagcgtatcgatcaccttgtccattccgtccatattggaaaccgttctgcgtgaagaagtaatgccttctccgtcgtaaatatcagagattttaccgattgaaatcacatctaagccgctgtccttcaattcattcatgacagtgcgatcaaacggtttaagggcatagtcatggcggtttggcgttcgtttgaattgaccccgctctccgacgaacggccgtgcaataatgcggccaaccatatatttcggatcaagcgtcagctctctcgccgtttcgcaaatgcggtacagctcctcaagcggcacaacctcttcgtgagcggcaatttgcagaacagagtcagcagacgtgtaaacaattaaagcccctgtctccatgtgctcctggccaagctcatccaaaatcgctgtgccggaagccggcttgtttccaataattttgcggccagatctcttttccagctcttgaagcaattcatcaggaaagccttccgggaacactttaaatggtttatcaatgtataaacccataatctcccaatggccggtcatcgtatcttttccgtttgacgcttcttgcatttttccataatacgcaagcggatgttctgttttttctacacctttgatatcttcgataagaccaaggccgagctttgccatattcggcatatgtaatccgttcatatgctcggcaatatgaccgagcgtatgagcgccttcgtcattaaagtcagcggcatccggcgcttcgccgattccgactgagtccatcacaattaaaaacacacgattatatttgtatgcaggcatcttgaaagcctcctttttttctatacgtctattgtatcgctaagaggtctgacaactcaagtataaaccgttttcattcccgttgacaatgtatttggaaataatgagaaacttcaatattttctgtcgctctaaacaaaaaagccgcagccacctgcggctatgctcgcggatgaaactgcttgtacacatccttcagccttgttttcgtcacatgcgtataaatttgcgtcgtggatatatccgcatgaccgagcatttcctgcaccgctcttaaatctgccccgttctcaagcagatgcgtcgcaaaggaatgcctaagcgtatgcggagtcagctctttcttaatgccggcttccaacgcgagttttttcaggttcttccaaaatccctggcggctgatctgtttgccgtgatgatttaaaaagagggcgtcagacacattgttctttaacagttttcccctggcttttgtcatatattcctcaatggcggaagcggcggcttcaccaattggcacaatccgttcttttcttcctttgccaaagcatcggataaaccccatagataaatgaacatctgccgttttcaactcaatcatttcactgactcgtatgcctgtcgcataaagcagctccagcattgctttatcccgatagccgaatgggctcgtcagcttaggcgtgtccaataatcgctcgacttcattgagtgcgagcaccttcggaagcgcccgttccgtcttttgtgtttcgatatgaacggaagggtccttatccgttactttttccctgagcagaaattgatgaaaagagcgaatggatgccaaatgccgcgccgatgtcttgccggatttccccgagtccttcaaatgctttaagtattggataatatgtatgcgggtaacgtgattccaatctgtaacatgaagggtttctgttaagtagagagaatagcttttcaagtcacgttcataggatacgatcgtattttgagagagccctctctctaccataacgtagtggatgaaatcctttatttgatctttcactcttgatctactccccgttttggtaaaaaaagatcaaccggtcgaaccatccgcctttttcatcctgatccatttcaacaacttttacagcggagccttccggtttatcataccgatgatagttttcatactcttgattcacccatatcatagcataatagaacaaagcggtaaaaccggtaaacaggatgaaaactttcaatgcatcgacagctgttttcaggaatcttcccatgtcctaatcgatcctttccctatggttccagttatataaaccatatgccaaatcagaaaggttttatacatagaaacagcaaaaaaccctttccccatgagaaaaggttcgcgctcggcaccgtctattcagtttcttttccgttacagcggtggcaaatgccgtgaaacgtcaatctatgatctttaatcttaaatttccaatcacgttcaatgatttcttccacgtcttcaagcaaatcttcttcaatttcatcaacggctccgcactccatgcacaccaagtggtgatgaaagtgagctgcgccctctttccgaaggtcgtaacgggacacaccgtctccaaagttaattttatctacgacttttaattcagttaataattcaagcgtacggtatactgtagcgagaccgatctcaggagatttctcttttacgaggaggtatacatcttctgcgcttaaatggtcttcttcgttttcaagcagcactcttactgtcgcttcacgctgtggcgtaagtttatagctggatgagtgcagttgtttcttaattcgatcaatacggttttccatgtctttccctcctacgccgcattccatgactcattataacaaaatacgcgcagagttccaactataattattataaactgataaataaaacggttttcttttaataataattttaaaaaagtctagatgtaagcttttccattaaaacaggagataagtatgcttcaaagagagatgagatcagcgctaaaaacagaatgaccagcagcacaaaggcataccgcccgaaccattgaatcggcgcgtcatggaggcttcgtttcacgaacagctgtctgattaactttaaagaaaacgcaattgcacatgtgcccataatgagataagccggaatcagcagcacattttgcggtaaaacggagacaaatgataggaaaaacccgcttactcccatctgattgactaaaaacccgacagtaaagccgacgacgatccctttcagaaagatcatgatgaaaataatcggcatcccaatgacggaaattcccagtatccacatcaggcctaaatactttgcattatgaaagatactttgcccaaacatatcagctgaacttgcctgttttccatccgaaagctgtccaaaaaattgacttaagtagtagtataaatcttctttctggctgatggtcatactgttgacaataatcgcgccaaagatgacacccatgaaaaacagcactgacacaaatatataaagagagagatgatctttaacatgcctgagaaacatgtccttataagagatttttcgcataccgtttcctcccgcccgctctagtgatttgatttaatagattgtatgaaagaaacagaaaaacatgccctttttcaaaaagaaacgatagagacgaatgctaggcggctttttggggcacaaaaaaatccctatcatcaactgctgtatgatcataaggattcttatgcttccgtttattcaaaatctcttttttgctttttgtcattctttcatgtgtgctaaaagatggtgtgccgcctcttgataataagacgtcacgtccgccgtttctcaatcgatgctcccgcttctttttcgcttggctttttgccatgtgatcactcccttttttattttcatagtaatgataacaaaattgaacacagataagaaaaaaaacagcacctgctacggaaggtgctgtttagctacatttatttcactgctgtaagagctgcatgctcgacagctgctgctaccgcatgatggacttttgaatcaagcggctgagggaccacatcaccttgtttagtgcaggctgcgatggcctctgctgctgcgacaagcatatcatgattaatctccatgctttttgcgttaagcgctcctctaaaaatcccaggaaaaccgagtacattattaacagaacgcccgtcagctgcatatgcggcgccagcctgcagcgcggcctccggctcaatttccggcttcggattcgataaagccaaaatcacttgaccagaacgtacaaatgtcggttttattaaacccggaacgcccgttgtagcaatgacaatatcacatgtttccataagctcctcaatactggaaactgcctgtccgccgtattgttcgagacggttcattgctgactctgatttgtctgttccgtacacagcattcacaccataagccatgaacatccggcagatggccacgcctgctgcgccaaggccgatttgccccactttcgcttccttcaggtcaacccccgcactcctgcatgccgaaatggcagctgccagcgtcactacagctgtaccatgctggtcatcgtgcataacagggatgttcagctcttcttttaggcgatcctcgatttcaaaacaatgcggcgaaccgatatcctcaagaaggatgccgctaaagcccggagaaatatgttttactgttttgatgatttcttcaggatcactcgtatcaagaagtatcggaatgccgctaatacccgccagctgatcaaacaaagcagcctttccttccatgacaggcatgccagccacagagccgatattccccaggcctaaaattgcggttccatccgttacaattgcaacagaattgctgatcgttgtataaatagaagctttttcaggttctttttcgatcagtcggcacacgtccgcaacacctggtgtgtagacacgtcccagctctgccaatgaacggatcggcattttgcttttcatttggatttttccgccttcatgtgcggacaggacttcatcagatacggtgtgaagcctgatcccttctccgagggcctgtacagccgcgatcacttcctgaagctgttcttcattctccacttgaacggtaatattccgcattgtgtaattgggtccgacttttaccgtctccacttcaccaatatccccgcccagaaggccgatggccgtagccacccttccaagatttccgggaaccgaaggcgtttcgatcatcagtgtccgaatcatgtgtttcgctatcattcagtgatcctcccctattagcctagtttttcggctttaactgtattgtttttcgtataccatataaattttcctgtataaccatagataattgcaagacctattgctacaaaactgagccacataaacggcagataagagaaggtagaaacacctaaaataccagccatgtaaatcccattatcagaccaaggaaccatccccgaagtcaatgttcccccgacctctgagttacgtgataacactcttctgtccagatgtaagcgatcatagctgtcttccataattttcggagtcaaaataagagatacatacatcgcacagccgaagatgtttgctaaaaacgctacgatcagtgtagacaatgtgacattgccggctgaagttaatttcttttcaaacgttgaaacaatgacttttaacacgccgagtttctcaagcagaccgccaaaaccaaggccaaagatgatgacgacgagagaatcaagcataccgacaattccaccgcggtttaacaagccgttcaaaaattcaacatcagttttaatagagaagccgttgtacgcagttgcaatcgcatgggcaatatccatcccttggaaaacgacagcccagattgcaccgagtaaagcgccaattacgataaccggcatagatggctttttcatcgccaataagactatgacgacaactgccgggatcagcatccaaatatgaatgtcaaacgtgttttgcaaagatgattttaagaattcaactttatcaagatcaatatttttcccgccgtacataaatccaacaactgtaaagagtatagctgtaatgacataagcaggtattgataaataaagcattgctctcacgtgagccaatacatcgacttttgatagtgaagaagctagaactgtactgtcagacagaggagacagcttgtccccaaaatatgcgcctgaaaggatagctcccgctacaagaggaagcggaatccctaatccttctccaattgcaatcatggcaatgccggcagttccgactgttccccatgacgttcctgttgccacagacataatggaacaaataattaacgttgccagtaaaaagatacttgggtgaataaattccagtccgtaataaatcaaagtgggcacaacgcctccggcaatccatgttccgatgagcgccccaactgaaacgagaatcagtacggcttcaaggccatttgatatcccatgtacaatcgcattttgtaaatctttataagaataaccgagtcttatacctaaaagcattgcaataaaccatgaaacaaaaagcgccagctgtatcggcaagtcgagaaagactgtaaacgatagaacaagtgctaaaaatactcctagtacaataataatttcaaatagtgttggtaatcttacatccttcaaaagaagtccccttcatgtaaaagctaaaacgctttcaatatatagtgcaacacgtatactatacttcctcatccctatgttgtaaacagcttattcatccgactattcggagatgaataagctgtattttgtacaaattttatttttctaatagttctttccctgcgatacctggtttggtcatctcatatgggtttaaaataatatccaattcttcttcagtcagcacatcatgctgcagacaaagatcccggacagattgccctgtcataattgcttccctggcaattctagctgccgcttcatacccaagatgcggattgacagctgtgatcacgcctgcgcttttttctacgtattgcttcatacgcttttcgttggcttcaatgccttttaagcagttgtcagtgaacgaacggaagccgttgttcatgatgctgatggattgaagcaaattaaagacaagcacgggctccatgacgttcaactcaagctggccggcttctgaagcaaggcagattgtattgtcgtttccgataacctggaacgcaatttggttgatcagctccgccataaccggattgactttccccggcataatagatgaacccggctgacgtgcaggcagagaaatttccgcaagtccggcacgcggtcccgacgccattaagcgcaggtcgtttgcgatcttcgacatgttcatcatgcagacttttaatgaagctgatacctctgtataggcatctgtattttgtgtcgcatcaacaagatgatcagcgccgacaagaggaagcccgctaatatcagcaaggtgctttactacctgtttgatatattcaggatcagcgttcagccctgtaccaacagcagttgcgcccatgttgacttcatataggtgctggcgcgattgcttgattcgtttgatatcacgctcgagaacacggctgtaagcttcgaattcctggccaagacggatcggaaccgcatcttgaaggtgtgtccggcccattttaataacagagtcaaactcctgtgctttttgcttaaacacgctatgcatatcttccattgttttcagcagtttttctaagagcttcaatgtggaaatatgaatagcagtcggaaacacatcgttcgtagactgtgacatgttcacatgtgtgtttggacttaaatggatataatctccctttttatgtcccatgatttcaagcgcccggtttccgataacctcattcgcgttcatgttcatagaagttccggcaccgccctgaatcggatcgacgataaactgatcgtgccacttgccttcgagaatctcgtcagcggcttgtacgatagcttggccaattccttcatacagccgtttcacgtccatgttggcaagagccgcagcttttttcacaatcgccagtgcgttaatcatttcctcatggattttgtatcctgtgatcgggaaattttcagaagcacggagcgtctgaattccgtaataaacatctgcttcaatttgtttttccccaaggaagtctttttccacgcgatattctttttggccgtttaacataatctttaaccttctttctctttgctggttatcgtttttacattttacaggacaacgtcatcagctatcggcgtttccataattctcttgacgacaggaagatccgaagactgacctagtgcccacatcaattttggcacaattgcttctgtgttcatatttcttgatcggataattaagtcttggttgactctgcggccaacttcgtaaatgctcatgtcttcgccttcttcaagacattgagtcgtaatgaccacgacaatgccgctttcgatcagctcattcacttttgacaaaatgtctctgccttcaaacggcacccctccgctgccataactctcaatgacaattcctttgtacatgcttttcagggcatcaaacatttcgggctttaagcctggatgcagcttcagcagacatacatctgtacatagtgaagtgtcaactgtgaaggtgtcgttctcaggttccgttacttgtttgttgtattcgatcccgtcttcattgataaaagcgatatatgggtaattgatgctttcaaatgcgtcgtagcttttcgttcttaatttgatcgcacgcgttccctgaatgactctgccgtcaaacacaacataaacgccgcccacgccttcacaggcaaatcgaatggcatctgtaatattttttttggcatcggttttttggaacgtgatcggaatctgcgagccggtgatgacaatcggctttttggcatgctgcagcatatacgatagtgcggcagatgtataggccattgtatctgtaccatgagtaataacaaacccgtcataggcatcataattttccttaacggcttccgctatttccacccagtattcaggctgcatattggtgctgtctatattcataagcgactgagtttccattgtgtaatcgttatcaagttttgatacgtaacttagtaattcatcagccttgactccgggagccagcccattttccccttcaactgaagcaatcgttcccccagttgtcaacatcaataattttttcataccatgcacctcttcactgtatctaaagatgggttgcgagaaggtattcgcttttcgcatacttttaatgcaattatagacacggaaaataaaatacgcaagacattattattcaattcgcgtacacttcctaatacctatatgatataatcagctcaaggtgaaaaaggagcggaagttcatgaatctagatcgtttaactgaattgagaaaaaagaaaaattggtcgcttcaatatacagctgaccttctcggtatcgcaaaaagcacatatgccggctacgagtcaggctaccgacggccttcacttgaagcgcttgccatgctggctgacctctttgacacaacctgcgatgaacttttaggccgcgagaaacaaaagcagactgctcctcaggccatagaattggccacgtggagcagccttgactttaccatttctgttgatggccagccgctgagtgaagatgaaatcatccagctgattacctttatacggacaaaaagaaaagtacaggaggaactgagttaatctttagctcacggtttaattttaccgtaggttcctcctcctccggctttcaattccagttttccggatctcgcttttacgataagcgccgcggttttcggcgggacaacgcgagccaaatcttcttctgcagcctcgtgaagaacagccatttctgttccgaaggctttttttagtttgtccagcgttttcgggcctacacccggaacaaattgcagcgggatctgatgtacatatcgcggacgcgggacgcgaacttcaagctgatcactcaattcatgcaacctttcgctgactcccttggtaaatctggtatttccgcaattcgcgcacgctgtttccccgcttacagcaggctctccacatgcttcgcaagccgtctgataatatttccccaataacgggtccaagccgtaatttgcgataattttcctgtcatcttgtccctttaatgcaagagcaaattcagtaaaatcagctgactgcacatatagttcattatattctctgccgattttccccaacgaatgcgcatcagaatttgttaaaaaaggatacggattcaattgcgatacgtgtgatgccatgtctgtatcacagcttaatccaagctccaccgcgtctatcatagatggatcaaaaacctcagttaagctttgtttaaccccttttccatataagcttttatgcggagtaaagatatgggcggggataaacaggccgcccatatcctgcacttttttttgcaggtttaagcccgtttcataaatccgctgcgagcttaaatgaatatttttcagccgggctgacagccagtttgaaaactgtttcatagcagccagcgtcggcataaatacgagcacatggatcggtccgctgcaggcttcatcataaatctccagctcgctccccaataaaagagtcgtgctgcgataacggattcctcccccgtcaagctcgcgatattttccagatgaaatgccttcctcaagctctagaatgacttccggagaatgacagtcgataatgccgaggagttcaattcctttatgttcactggcctcaaccaaaattctgtccagtgttaatgttttggcgcctgttattttgacagcccttcctgtaaaggtccggccgatatgaatgtgcaaatccgcgtaaatctttttcatttttgtgcttggagcgcttctttcagctgaagatactgaatcgcgtaggctgttttagcatcgtatacttcacgcgattcaaccaactttagcgcatcttcaagcgtcacctccatcacttcaacaaactcgtcctcatcaagctcccgtttttcttcaagcacagaaagctcctcagcaagaaaaacgtgaacgatttcatctgcaaatccgggtgatgtataaaacgcagttatttttgtcagtttttttgctgtataaccggtttcctcttcaagttcccgaagtgccgtatactccggctcctcacctttttcaagtttaccggccggaatttcaacgatcgtccgctcaagcggcttacggaattgtttgaccatgatgattttcccttcatctgtgacggctagtaccgctacagctccagggtgtttcacaatttcacgtttactggctttgccgtttggcagctctacatcctcgacataaagatcaatgactttacccgaaaagatctgttctttggcaattgttttttcttctaatgatttcatttcttcatctcccgttctgtctctatatgatgccccatacattttatcatactagagcaaaagggggcttcttcgtgaaagtgcaccgcatgccaaaaggtgttgtcttagtcggaaaagcatgggaaattcgggcgaagttaaaagagtatggacgcacatttcaatatgtgaaagattggatctcaaagccataaaagttgaaactttagctcctttatattacggtcaatacaaagcctaaaaaaggagtgtgcacatgagaaagcgcaaattgggtacatctgatttagacattagcgaagtcggactcggctgtatgtctcttggaactgaaaaaaacaaagcattgtccattctggatgaagcgatcgagctcggcatcaactatttggacacagcggatttgtatgaccgaggacgcaacgaagaaattgtcggtgatgcgatccaaaacagacgccaggatattattctggcaacaaaagcgggaaaccgttgggatgacggaagcgagggctggtattgggacccttcaaaagcttacataaaagaggcggtaaaaaagagccttacacggctgaaaacagattatatcgacctttatcagcttcacggcggcacgatagaggacaacattgatgaaacgattgaagcgtttgaggaattaaaacaagaaggtgtcatccgctactacggcatttcttccatccgcccgaatgtgattaaagaatatgtaaaaaaatcaaacatcgtcagcattatgatgcaattcagcctgtttgacagacgccctgaggaatggctcccgcttttagaggaacatcaaatcagcgtagtcgccagaggtcctgttgccaaagggctcttaactgaaaaaccgcttgatcaagcttcagacagtatgaaacaaaacgggtacttgtcctattcattcgaggaactgacaaatgcccgcaaggcaatggaggaagtggctcccgatctttccatgacagaaaagtcgctacagtatctgctagcacagccggctgtcgcttcagtgattacaggcgccagtaagattgagcagttacgggaaaatattcaggcaacaaatgcacggcgtttaaccgaagaggaaatcaaagcgctccaatctcatacgaaacaagacatttacaaagctcatcgctcatagcagaaaaaccagcacctgtacgggtgctggtttatttatattgatgccaatccatttggctttcatttaggagttcttcaaagctcttatttttttcgatctcttttttctttctgatctgttctgctttttctctttcctgcctcttttcatcctcttccttcaattggctcttcatctccataagctttgctttgatatcggattgaaggccgtcttttagctggtgtttgtcagcggatttttgttttttcatgcagacttcccccatgttttgttttgaagacagtttatcacggagcatatacactgaacaagcagactctcttctggtcactttctcagcggagcagtgtttaggtataatgatttcaaacacgaattacctatatttagttgaaaggtgctgtgacttttgaagaaaatccttttggccattggcgctctcgtaacagctgtcatcgcaatcggaattgttttttcaaatatgattctattcatcaagaaaaaaacagatgaagacattatcaaaagagagacagacaacggacatgatgtgtttgaatcatttgaacaaatggagaaaaccgcttttgtgataccctccgcttacgggtacgacataaaaggataccatgtcgcaccgcatgacacaccaaataccatcatcatctgccacggggtgacgatgaatgtactgaattctcttaagtatatgcatttatttctagatctcggctggaatgtgctcatttatgaccaccgccgacatggccaaagcggcggaaagacgaccagctacgggttttacgaaaaggatgatctcaataaggttgtcagctggctcaaaaacaaaacaaatcatcgcggattgatcggaattcatggtgagtcgatgggagctgtgaccgccctgctttatgctggtgcacactgcagcgatggcgctgatttttatattgccgattgtccgttcgcatgttttgatgaacagcttgcctaccggctgagagcggaatacaggctcccgtcttggcccctgctccctatcgccgacttctttttgaagctgaggggcggctatcgcgcacgcgaagtatctccgcttgctgtcattgataaaatcgaaaagccggtcctctttattcacagtaaggatgatgactacattcctgtttcttcaaccgagcggctttataaaaagaaacgcgggccgaaagcgctgtacattgccgagaacggtgaacacgccatgtcatataccaaaaatcgggacacgtaccgaaaaacggtgcaggagtttttagacaacatgaatgattcaacagaataaaaaagcgaaaggcctcttcggctcttccgcttttttatgttacagaacgtcggtaatgccatccatattttctctgatccattcaatcgcaagatctatcgttgtaaactcctgcgtctcgaaggtcatttcatcctgcaatagccagacatctttcttgatggactctgctcctccgattgaccagtgaagcaaggtatagggatggttttgattcaggaaggatacccacgttttattttgtgctgtgttcttcattgccttcagcttttgttccacgtttcgcgtctcctactttactaatatgctcattctggggctgagcatttcagccgggcttttcagcgccaatgttttggctttttcattgtaatcgatcgtcatttgatcgtcaaaaaacactttttgcgacgattggatatacagcggaatgccgttcgtttccagctgctcgcactgtcccgttaattcttctgccagccagattgtcgggacaccgcttacagcgcagccgcatccttctgcatcgtaacgaagctgggctttttttcccgggttggcgtcaaacgcctgctgcagtgcctgttttgctgcatctgtcacatgtatgttcataaggtgaaacccccgttttcatcattttcgctattgtagcatacaacactgccattcgcattgtttctgccttttttccaccgcttcgcattttcttctgcagtcttgatccactcatctttcccttgtatgtactgattgatgctgtcaggatgctgggccgccagccgttttttgagaacggcatattctttcgctatgtttggatgagctctgagataatctctgaataacagatgcctttcaatagcagggtttccctgttcgtacatatggacatgatgagtgcgtttatttccgcccttttggaaataacgcctgcccgctatgccgttctcaccttttggtatatagccgttagccttcatttgttcatcaaattggctcacggcttcaatgcttctgacttcaattaacatatcaatgattggcttcgctgccatgttcggtattgatgtgcttccgatgtgatgaacagcgataatctccggcccgaacaccagtttcagccgttctttttcttcatcgaaacattctgcccatttttcgttgtagagaatgacctcaacttttcttttcggatacaaatgaaagaccgtcagcaatagaccctgcgctgctttgacggtttctgccttttggaatccggcctgtgtatagagtgacacagccggggtattgttctcggctgtgactacttcgattttctcagcgtcttcattatgatcaatgacaaattgcagaagcgctcgtccaattccttttctgaaaccgtcaggatgtacaacaagcctgcaaatggtgagatgatgcatgtttttctcatatgaaatgacaccgatcagcttgccgttttcccgatatcccgcaaaccgctcatgggatgcttgaatatccttcaccttctcttgtaaagcgggaataccgtcaaaaccgataatctctgtttcctttatgtaggcggggatctgtacggctaaaatctcacgcgctatagtgtcttccttatgctggagaaattcaatcattcgtgttctcctgaaacagccgctgtctttcgatttttgcgacgcggactgcatacgactcgtaccaaacgctttttcctttttcttttgccgcttgatgttcagtgtgatgcttccaatggttaattgcgtccatactgtcccaataggaaactgtgatgccccttccatccgcttcacgtacgctttccacgcctaaaaatccaggctgatccgccgcaagcgataccatccgctccgctgtttctccatatcctgtgtcattttcgcttttgacagaagaaaaaatgactgcatagtaaggaggctcaggtgtttttgataaaaaatccattatatttccccctcatatgtttttgacaaacagtaccctgtcttggcccaggccatcatagtttgcaaacactgagatgccatttaccgtcttggtgcccttttcaatttcaaaccccaattttgtgtgatatgcgattgataccttattcacaggtgaagtgacgcacttcacccgggtgcagcctctttgttttactgtttcgataaatacatcatacaattgtttcccaatttgcatttttctgaaatctggatgcacaccggaaaaatgaatgtacgccgtttcaggatccgattgcgattgaaatccgattaaaaatccggtcatgctgttatgttcggatgtaataaagcttgtgtcctgaaaatgctcaaaaaatagtctcggcaatttttctttcagctgtctgccgccccaccattcattcagtacagacgttaccatttcataatctgaagacgtgattgttcgaatatccattacgatttgatctccctccgtctggcaaaacgaatgtcagctctttttctcacaatataaaaattatattttgcctggctggaattgtaaatgccttctttcctgtatcatacgtttccagactgccgagggaacaatgtttgatcattttatgcctatttctcccccaagcaggaggagagactttacagcacaatatcaagcacttgatcaagtttcagcttataaagctgattctcgtctccttttatccatactgctttttcaaactcttcataccggcagatcttcccggtgcagcggacaatctcaccgtcctgaaagcagctgacagtgatatcctgagcaaactccatcgcggcgcaaagcgtttgattcagctcttccagcttatcagggtcaaggatcggcttttgcagcttctgtttaagtcgctttctctccagcaggctttgcttatgttccggcagaaacatcctgctcccttcccacagcaggttgcccctttttaaatggtcgttcatttataatgccccctattttagccgcacgttcaaatgcctggcctgccactgtcagtgacgccgccctgatgattgctgtatcgccgaatcgatttttaatgccatccatcacatagcctaggctcattttctttgcataatcctgaaataaattgagctgccatatgtcatcagatgagagctgagacagattgacaccgaggcggcggacgggtttcccgtcccaaaatgtaagaaacagccgtcgtacagcctcatatacatcctgcgtagaattagtcggctctgccagcttcacttgccggttgaagcccgtcggccaatcaaaatcagcacccccgcagctcactgacactgtctgccccatgaccccggcgtttcggcttcgcctgcacacctcttcactcagctcaagcaatacgaccttgatttctttgtcaaagtgttcgtagtctctcgggagagtcattccatggcctatcgccttttgcccgtccagagacgaagttgacacaggggaatagtcgattccgtttgccgtcatccacagcacgtggccgttaatgccccatttcttttttaaaagatcgagtggaaaagccgcgagcccgccgatcgtgctgatgcccattcgatttaaatgatgcttcatgcggctcccgacgccaaacatgctgcccaccgggagcggccacatttcggttttcatattttctttcgttaaggtaaaaataccgttcgtattctttttggcaaaattgtcacacgcaattttggccagcgctttgttagggccgattccgacccgtgcataaacgccgatctcccgcatgattctgccctgaatgcttttcgcgatctccatcggcgtcccaaacagcttctggctgcctgtaatgtccatgaactgttcatcgatagaataaggctccacaaggtctgtatactcctcgagaatggccgtaatttgcagtgatacatcaatataccgttgcatacgcggccggagcacaacagcctcaggacacttttcctgcgcctcccacagccgtgaagcattcaccacacccttttgtttcgccagcgggcaggcagccaatacgactccgccccttttttcagggtcacccgaaacaatgacgggtctatttttcaaatgtggattttccgctttctctacagatgcataaaacgattgcatgtcaacgagaaaaatcactttttctttcatcatacacacctctaaaaagaacttatgttcgtttttcattatatgcgaaagtatgttcgttttatactggtaaatgattcttgtctgacagaaaatatgatccaagggtttgagagaagaaaaacatttagtagaataaaagcgaagcataaggataggagagtcatgatggagaaatttgtcgaaaaaatgctgggacaggcattgcgtcaatacggcagaaacgttgctatagatccgttaagcccgtatgaaaaacaaagcctgaaagcggctctacaagagagacggaatgaagaaccggatgaggatctgcatgcgcatatagaagatatcatttatgactatgttacaaaccaaggcctgttctcttaaacgcatgactgtcagttcgttcagccgctgatgcggcttccctttgaaaacaccgcccgaaacaaataaacagtttcaggctcacagaaaaaagcaggattttctcacgctccatagattcatatggcctggcataaaattcccctcagtgctcgcgcaaaacggaataagctgtccatgatcacgcgtatacactttttcgaagagatgtgctctcttgttctgtcatggggcccatgccggttttcagcttacatcttgatctcatagccggtttcactgccgatatgatccacgtcctggcggcttaaactaacacactctcactgaccaatcgctttgcttttcatcggacatcccgtcattttccttcttcaatttcaagatgtaaactccgtcagccacacgcatcctcaacgcatagtatattgccatccatacaatcaggcatactacatgtcaaaaacgaaatattttgaataatctattggagaaggaaattttttcatatatgatagaggaagatcttacatacaggagagaatataattcatgaagaaatggaaagatatccacccgatcagctggacaattataatcggaaccattttcggcagaatggcaacatcgatgagcattccttttttagcgatttatttgacagccgtccaaggcgcatcagcttcctatgcagggctggtcattgccgcgagctcatcagtcggcatcctcgcaagcttttacggcggatatatctcagataaattcggcagaaaaaacatgatgcttgtatcgattttcggatggatgctggtatttgcaggctttgcggcggcatctcatctctgggtgttttttgtagttaacgcattaaacggtctttgcaaatcactgtttgagcccgcttcaaaggccttgctgtctgatatgacagaagaaaaaacgagactgctagtttttaatttacgctatgcagctattaatatcggcgttgtcttcggacctgtgcttggcctatatttcggctcatcgcaatcgactacgccctttttggtgcctgcagtcatttacggactatacggaattgtgcttgccctccaatttaaaaaacatccatccttatcagcaccagcccaatcccgaaatatgagcgtgcgggaagcgtttatggtcacgcaaaaggattatctttttaccattgctttggtcggcattacgctatgcaccttcggctactcacaatttagttccacattccctcagtatatggcgcagaaccccttgatcggcaatggaacgaagctgtacgggctgatgctgacattaaacgcaatcgtagtgttggcgacgcaatttcccattgtccattttgcaaaacggttttcgccgctttgttctctgatgctcggtaatgtgatggttagcatcagcatggccattttcaccgtatcgcacggtgttccatcaattgtgatgattgtcatcacatttacaatcggcgaagttcttttattctctatgatggatttgtatgtagaccagattgcaaaaccaggattaaaaggcacttatttcggggcaatcggtttttcacagctcggaaacgtcatcggcccttggatcgggggatatgtatagacctgtttagcgctggccggccgatttatattttttctgtcctgagcggcattaccctgctcggcctgccatttttagcgttcgcctatcggcaaatgaaaatggagaccacaaaacaccgttcccatctggaaaagccgctttaaataaaaaacggaagagaatgaaactctcccgcaaacatgaggtgaagaacatgaatataggtgatgtgatgtttcagctgtttgtatttattatatttgccgctgtcatctttgcggctgttacaggcttcaagtatgcgaaaaaccgaaaagcgcagctggatcgcattgagaaaaagctgaacagcctgtccgaagatcacgattaacagcttggggcaacgagctctaccttaatccggtccggatcctcacaatagactgcataatgcccgtctcctccggcaaaaggatgcctgtctcggtacaacacacgatagccttttgccgtcaatttttcggtcatctgatcgacttgaagcttggattcagcatgaaatgcgagatggttcagaccgactcggcatctatggtattccggctctagaaatggctctttcgcctgcacaatcactaggtaaaaacgatctttcttccagctgatgcctgagctccatttttgatactctttatagccaagttcttttaagaaccatccccaaaaccgcctagacgcctccaaatcagagacatacagttcgatatgatgcacatttcataccctccttaccagcacttcctcgaccttatgcccgtctcccttacgcaaaatgagatctgacctgaatttagtcggcaaaatattttcatataaattcggccggttgacactctcccaaatcgaggctgccatctcgtcagcctcctgatcggacaagtctttaaatttatgaaaatatgaatcaggattttgaaaagcagtttcccgaagcaggcgaaaacgctctaaataccaagtgaaaatccggctttcctccgcatccacataaatcgaaaaatcaaagaaatcggaaacaaaaatacgcgggttttcccggtcatcctccaaggtgggcgactgaagaacattaatgccttcaataatcacaatatccgcctgttctacaacctcgaacacaccttcctcgcggtcataggttagatgggaatacaccggggcctttacgctgtcctttcctgattttaagtcattcaaaaattcgagcagcgcctttacatcatagctttcaggaaacccttttctagacatcatatttttctttttcagctcggcagtaggaaataaaaaaccatctgtcgtgataaggctcacttttggacggtcaggcaaacgcgaaagcagcttctgcaagatccgcgccgtcgtgctttttccgactgcgacactgccggcaatgccgataataaacggaattttggctgaatgtgggtgcttcaaaaaaacattgacatgcttattgcgttcagccgcagacttgacatgcaaatgaagcaagcgaacaagcggaatatagatcgtttccacttcttcaacagatagataatcattcaatccttccacagcttttgcctcttcttcagatacagcaatcgacaaatgccccccaaaaccagaccaagacgcccgattgtgctgtgtatataaagtatgtaggttaagttctttatttttcactgtttacacctgactctctgtaggttaaaacccttacaaagattgtaacggaaaaccttttcactgtctgcttatttttcatttcgtttttttagcaaatcagcaccaattcggttatacgcggccatttcatcttttggaaccatgcttcctcccgttccccagacgacatgtacggcatgttccatcttatatttctgaccatagcgccttccctcttctgtcgaaaaaagctgaatcggcccgaacatgccggcaagagcagagggctctaaatatttatcttcagatacagccagcatatgaagcaaagtataaagcgtattgtcctctaccgtataacagccgctcagaagcggttcaatcagcttgccgacaaatcctgacggcctccctacggcaagtccgtcagcagcagtctgattatccaggccgatatcctggacggagatcttctggtgaagtcctgaataaagccctaacagcatacaaggtgaatgagttggttctgcgaaaaacacatgaacatcatctccgtataaaagcttcagcccaaatgctacaccgcccggtcctccgccgactccgcacggcagatacacaaacaagggcgtctcaagactcggctgtatattcatacagtcaagttgtgtttttaatcggcttgcagcaacagcatatcctaagaacagctgacgagaatgttcatcatcaataaaataacagaatggatcttgttccgcctgccgtctcccttcgttgaccgcttcgctgtaatctgtttcgtactccataacagtgactcccttttggcggaggagatcctttttccactgcttagcatcggcggacatatgcactgtcacgcgaaacccgagtgccgcgccgatgatgccgatgcttaaacccagatttcctgtcgaaccgacagcaatcgaatagcgggagaaaaacccggtaaaccgctcttcctgtaagatgcggtaatcatcggtttcctgaagcattccttcttgaagcgcgagattttcagcatgctttaacacttcataaatcccgcccctcgctttaatcgatcctgaaatcggaagctcatggtcgcactttaaaagccatcttcccggaaatggctgctgatatgccgcttccagcttttccttcatatgctgcacctcaaaaagcggagactcgatgattcctttagcgcctttcgtctcaggaaacacctcggcaatgtaaggtgcaaaccgccgcattcttttttccgcttccgctatctcggttgcccactcatctgcacggggtaatggcccctctttcttgcctgaatttgcccagaatacaggctctgcatcaatcagtttctgtataaacggatctttaagcagagcatgaaggacttctgaatgaactgacattcaacaatctctcccttccactatcaaaaactgcctcgtgagaaacaagccactccaccacaggcagttccatcattattttttcatgaacgcgcgtcctgccagcttttctacaagagctggaaacagctgatacagcttagtgccggcattcattaaacgcggaagattgatctcccgctttttcgtaaaaattgcagctgtaatttgagctgctacgtcatcaggatcaagcatccagcggccgacatttttggcgtagtccccgcctttatcagcaatggaaaaaaagtccgtctgaatcggtcccgggttgactgttgtcacataaatgccggttcccgaaagctccatccgcaaagcgtttgagtaacctaacacggcatgtttggtcgcggaatacaggctagacttcggtgttgcgattttccccgcttgagaggcgatattgatgatatggccctttttttgctcaagcatttgcggaagcaccgcttttgtacaggcgatcaggccgaagacattcacatcaaacatcgctttcatgtcatccaatgtagagtctaaaaccgtttcaaatataccgaagcctgcattgttaatcagtacatcaatcgagccgatctgatcgcggacccgggcgatatcctctaggcggccgacatccagaggaaaaatctcacactgtccgctccattcctcggttattttccttttgatttctatcaaacgatcctcgcgtctagccgacagcaggacatgggctccttcagccgcgcataagtatgcgattctttctccaagccctcctgaagcgccggttatccaaatcctttttcccgctatatgtttcacccatttcacctcttcattgttttaaagtatgcggtatttccttcccaatatgacgtgatggcttcttcagcctccaacacatcaaggtgacctgccgtttctgacatcgttaaaaacaattccttttcatatacagcaggaaaaagctgctgacagacctgaaaagcggtcatcggcttttcatccagcatgcgacgcacatcctccgtcctgttcctctgcttgtcaaaacgcttctcaatcagcgcttgtacactggtgataggctcgccgtgaccaggaaatacgattgttggatcaagttgagacagccttcgcaatgaccgctgataatccactaaaggctttgacctaacgtctcccgctttcggcgcttccaaaatcggattagacgagctgtttgccagcagtagatcgccgccaagcatccttccgcttttttcatggaacagaacgatatgcgattcagcatgtccaggcatctccaacacagaccagccctcaagcccatctatgcccataccttctctgattgattttgtcagagatctcgtacaggaaaatgcgtacgctgatcgaatcagcttttccgccttccccgtatcaaatggaacgcctaattcaggcagcagcttttgaaaaaaacgtttttgccaatccataaaggcttgatttcggctgatataaggttcgttgaatgtatgcccaatcacttcgatttcatctgaaaagacatcaagcaagcctgcatgatcagcatgatggtgagtcagtacaacctgctcgatatctgacaatttcacatttacagcggcaagctgctcttgtaaggctctggcagcctcttttgtattcggccctgcatcaataagtgtcagtgcatcaccttttacgaggtaaacgataacatcgccgacagcaaacggcgtcgggacgcggatcgcaattacatcttcagttgtcatccattcgctccttgtcttcattcattattcatattttagctttttctcgatcttgtgtcattattgctgaatgagaacaaacctttttgaaaaagctattgacatcagcttgtccgccattgcataatgaacaacaaactaaaacgagaaccattggaacgctatgacgaggaatagtatacaaggcaatggcctaagagagcgataccccctggctgaaaggtgttgcggcccgcttgtttgtagaagctgccctcaagtcgcggttaggaaaacctaaacgtttcccgcgttacgggatttgagctgagcacaatttgtgctaatgagggtggtaccgcgaaccttttcgtcctttacgtgatgaaaaggtttttttgttgttctgatagaaggaggatatcaatgaaaaagataggatttgtcggcgccgggtcaatggcagaagcaatgatcaacggcattttgcaaagcggcatcacaaaaccagaacatatctatattacaaatcgctcaaatgacgagcgtctgattgaattaaaggaaacgtacggcgtgcgtccatgcagagataaaaatgagtttttcactcacaccgatatcattatcctcgctttcaaaccgaaagacgcggcggaaagcatcgacagcatccggccgtatatcaaggaccagcttgtaatttcagtacttgcaggccttaccatcgagaccattcagcattattttggcagaaagctcccggtcattcgcgtcatgcctaatacatcggcggcaatcagaaaatcagcaaccggattttccgtaagcgcggaagcaagcaagaatgatataattgccgcaaaagctctattggaaacaatcggtgatgcaacactggttgaggagcggcatcttgacgctgtcactgcaattgcaggcagcggcccggcctacgtgtatcgttatattgaggcgatggaaaaagcggcacaaaaagtaggattagataaagaaacggcaaaagcactcattttgcagacaatggcaggggcaacagatatgctccttcaaagcggcaaacagccggaaaagctgcgtaaagaaatcactagtcctggaggcactacagaggcaggtcttcgcgctttacaggactcccgctttgaagaagcaattattcactgtattgaagaaacagctaaacggagcgcagaaatcaaagaacagtttgccggtgccgccttagagagacattcttagatgtaagacaaaaacagaaggcacagtgccttctgttttttatgtttcccgcagcagctggccggcagattctgattgctttaatagcgcggagatcgtaaatgaaagcaaatcgggaagcacttcaaaggaataaggcatatacaatctttccgtccatttatgcgggtctttaccagccggaccgacatttaaaaccgggacatataaagcctgatttttaccgcttggcaatgaatttcctctgttaaagagcggcatattgcttgtgtatgcatcaacctcctgcttttccagctgaagataactcaagtccgaaagtccggggaagtactgaacctcccgtaatgcaatgccgtatcggtcagccgcgtactgcataagctgatcagctgtattcctgatcaattgatcatccttcgaagaaaccgccggatacaacggcgggctgtaaaaaagcacaatgagcggcgcatcctccttacaaagcgaagcaagctcagaaacaattttcgtcgaaaaatccctgtctccaagctccccctgttagcaaaggcataatttagagcccgctctgtttccgagatccccgcacgcttttttgcacgcgagaccagctcatcaaatgtcaaaacagtgatgttccgctcaatcggctgaaatggctcaaattgttgaaaatcctgtgttttcttccgaacgttcgacatgatttcctccgccgcctgttctgctgttttaagcagcatctgatgcatctcactagctgagcgtttcattgacagcacattaaataatgtgacagctgtatgcggtgtctggactgaatatgcctctttcaagtccttttgcattaagtttaccggcggcggagtgacctcgccatcaaccttttcgcaataatcagcattcagttcaagcaaacggttaatctcagataccattaaatttgcgtttaggcctgaaaacggctctccaacatgtgtctcaatccccttgcagaaaaaacccgcaagcaccttgccaatgcttcctgtataaaaatattgctgctgatcgccgggaaatttttcaaacatcggttcggcattcaggcaagcggttaatgtgatatcatgctttttctccatttccttcaatgcaggaaccgcttcaatcatgcctcttgaattcacttcctcgtccggaaccgttatcaacagcagattgccctcaaaatgcccgttcattgccctctccagcatcgacagttgaacacaaagccccgctttcatatccatcgtccctcttccgaacagccagtctccgctttcggcatctcttctcacacgttccgggagcagctcttttttctctaaaaaggagctcaaaagctcagcaggcttgcaagccatatgtttaaattcgccgtaatcttctatgtcaacgacatcaaaatgactcagcagaagcactgtctttttgacattcttctttttgactagagccgtaagaaaagatctgccatcgtccatcggatgaagtattacatcatcagggtgcttttgaaaatagggcttgtccttcaaaataaaataaagatactctgcaagtgctgcctcgccctttgaaccggtgatgctttcgtattgcacaagagaagttaaaagtgccagcaattcgtccttcgtctgccaattcattgattccgcccctcctatgaataaaaatgcttctatactgaaaaataaactgatttctcgtctattatacagaaatgtttgacaaaaacggttcttttgagcagtttatatgacgggaaagatatgacttgatataatcaatctctaaaaaccttacgggaggcgaaagaaatggccagaaaattattcacaccgattacaattaaagatatgacgttaaaaaaccgcattgtcatgtcgccaatgtgcatgtattcttctcatgaaaaggacggaaaattgacaccgttccacatggcacattacatatcgcgcgcaatcggccaggtcggactgattattgtagaggcgtcagcggttaatcctcaaggacgaatcactgaccaagacttaggcatttggagcgacgagcatattgaaggctttgccaaactgactgagcaggtcaaagaacaaggttcaaaaatcggcattcagcttgcccatgccggacgtaaagctgagcttgaaggagatatcttcgctccatcggcgattgcgtttgacgaacaatcagcaacacctgtagaaatgtcagcagaaaaagtaaaagaaacagttcaggagttcaagcaagcggctgcccgcgcaaaagaagccggctttgatgtgattgaaattcatgcggcgcacggatatttaattcacgaatttttatctccgctttccaaccatcgcacagatgaatacggcggctcacctgaaaaccgctatcgtttcttgagagagatcattgatgaagtcaaacaagtatgggacggtcctttatttgtccgtgtatcagcttctgactacactgataaaggcttagacattgccgatcacatcggttttgcaaaatggatgaaggagcagggtgttgacttaattgactgcagctcaggcgcccttgttcacgcagacattaacgtattccctggctatcaggtcagcttcgctgagaaaatccgtgaacaggcggacatggctactggtgccgtcggcatgattacagacggttcaatggctgaagaaattctgcaaaacggacgtgctgacctcatctttatcggcagagagcttttgcgggatccattctttgcaagaactgctgcgaaacagctcaatacagagattccggcccctgtccaatacgaaagaggctggtaatgcccataagagatatcctgtagaggatatctctttttttatttttagagaaacgatcggctaaggttctccgtctccctagtagaaccaattagaggagatgactccaatgaaatcagcttggatggaaaagacatatacaattgacggatgtgcgtttcatacacagcaccggaaaggatcaagcggtgtaacgattgtctttgaggccggctatggtacttcttctgagacgtggaaaccattaatggcggacattgatgatgaatttggcattttcacatatgatcgggcaggcataggaaaaagcgggcaaagcagagctaaacgaacagctgatcaacaagtgaaagaattggagagtttgcttaaagcagctgatgtaaaacctccttatttggctgtttcacactcatacggagctgtcatcaccggtttatgggcctgcaaaaacaagtatgatattatcggcatggtccttcttgacccagctttaggcgattgcgccagctttacctttatacccgaagaaatgcacaaatcacatacgagaaagatgcttgagggcacgcattcagagttttcaaaaagtctgcaggagctcaaaaagcgtcaagtccacttaggaaacatgcctctccttgtgttgtcatcaggagaacggactgagaaattcgctgctgaacaggagtggcaaaacttgcacagcagcatattgtctctatctaaccaaagcggctggattcaagctaaaaacagctcccacaacatccatcacgatgaacctcatatcgttcacttggctatttatgacgtatggtgcgcagcgtgccagcaggccgctcctctttaccaggcagtcaattaacgtaaaaaaagaccgggccgtaagggattcccggtcttttatattattttgtttcacggtgaagggtatatttctttaaacgcggtgaatattttttcagctccaaacggtctggattggtgcgtttattttttgttgtgatgtaatttcggtctcccgtttcagtgcaggctaaagtaacatttactctcataattaacatctccttataaagcgtaatgattacgttttattatacaacgtcatcacaaattgtcaaataagagctccgccttcagcctcgcgggacgtttacctctaagaaatcatatgccgccacgctattggggaaaacgtcaaccgcttctttttgaagctccaaagaagcatctccctggtatcttgcgctgatatgggttaaaatgagctgcttcgctcttgcttctttcgctgttacagccgcttgttccgttgtactgtgataataatcataagcaagtttacggtcttccttagcaaaggttgcttcatgaacaagcacatcacaatccctcgcaagctcttttagtttgtcacttactctcgtatcaccggagaacacaacagatcttccctttttaggaggctccagaaaatcattcccattgatgattcgtccgtcttcaagcgttaccgtttcgccttttttgattttctgatatacaggtccgggcgggatgttcatttcttttaatacatcagccttcaaggaacccggtacgtctttttcctgcacacggtacccaaaggcttccactccatgaataacagataccgctgtgacaataaactgatcgtcctcaaacacgattccttcttcaatttcctggatcgcaagcggatatgtcaaatgggtcttcgtgacggcaaggcttgtttcaataaacgccttgatccctttaggtccgtacactgtcagctcgtcctctccgccttgaaaggaacggctccccagaagccccggaagtccgtatacatgatcgccgtgcatgtgtgtaataaagattttctctattttacgaggtttaatcgttgtatgtaaaatttgatgctgtgtggcttccccgcagtcaaaaagccataccgaacgcctttcttcaagcaattttaatgccaccgacgttacatttctcgccttggcgggaatgccggctcccgtccctaaaaaaagtaattccacgtttccttcctcctactagaaccagatacctacaagaatacaggatcaagctcaaaatgtgaatcttgcctctgaaaagaacaatcctttcgtgctagaaacattttttcagcattctgcttaaaaaagggcttaaatgtttgctttcgttgaattttagatttaaaatgaaggaaatatacggggtgtactaaaataaagcttcgaataaagtgaggtacttttagtgaaaacaaaccaacaaccaaaagcagtaattgtcatattcggtgcaactggagatttagcaaaacgaaaattgtatccgtctattcaccgtttatatcaaaacggacaaatcggagaagagtttgcagtagtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagcttaacgtattgcttaaccagctggaagatacatatcaaattcctaacaacagaatgttctacttggcaatggctcctgaattcttcggaacaattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgaaaaagtgaaggtgctgagagcactgcgtcctatagcaaaagacgaagtggatgaatactttgtgcgcggacaatatcaagctggtgaaattgacggtgtaccggttcctgcttataacgatgaggataatgtcgctcctgactccaatacagaaacctttgttgccggcaagctcttgatcgacaacttcagatgggctggtgttccattctacatcagaaccggaaaacgaatgaaagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactaattcacgactgtcttcttggcgatgcaacaaactttgcacactgggatgaagttgccctttcttggagctttgtcgactctatttctgaaacatgggcagcaaacaaaaccttatctcctaactacgaatcaggctcgatgggaccgaaagaatctgatgatcttttggcgaaagacggcttacactggtggaatatataagaaaaaaaagccgaaaatgcttgtaagcattttcggcttttttgcagttgccacaaaggtataacaatctttttaataacaaaacccccaaagctctagagcttcggggtttctattgattacttcatccattcagtatggaagatgccttctttgtcagtacgctcataagtatgagcgccaaagtagtcgcgctgtgcttggattaagtttgcaggcagtacggctgtgcggtagctgtcatagtaggctaatgcgcttgagaatgatggcaccggcacaccttgggcaactgcaagtgaaatcacttggcgaagcgctccttggtagctttctacaatattcttgaaatagctgtcaagaagcaggttgtcaagctcaggctcgcgatcgtaagcttctttgatcttctgaaggaatgccgcgcgaatgatgcagccaccgcggaagatcatagcgatttcaccatatttcagatcccagttgtattcttcagaagcagctttcatttgggcaaatccttgcgcgtatgagcagattttactcatgaacaacgcttttctgaccgcttcaatcagctcttctttattttctgtaacaggcttcacttctggtcctgaaagaagtccgctcgctttcacacgctcttccttcatagctgagataaaacgtgcgaatacagattcagtaataatcggaagcggaacgcctaagtcaagtgcgctttggctagtccattttcctgttcctttttgccctgctttatcaagaatcacatcaacaagcggcttgcctgtctcttcgtctttttttgtaaagatgtcagccgtaatctcaatcaggtagctgtcaagctcgcctttattccattcagcgaaaacttcatgaagctcatcagcagaaaggcccagcacctgtttcagaatgaaatatgattcagagatcagctgcatatctccgtattcaattccgttgtgcaccatttttacgtaatggccggcgccgtccggaccgatatatgtcgtacaaggttctccgtcaacttttgcagaaatggcttcaagaatcggttttacaagctcatgtgcttctttttgtccgccaggcatgatagaaggtcctttaagtgccccttcttctccgccggaaacgcctgttccgataaaatgaatgccgctttcagcgagttctttgttacggcgctgtgtatctttatagtatgtattaccgccgtcaattaaaatatcatccttctctagatgaggaagaagagattgaattgtcgcatctgttgcagttcccgctttaaccattaataagattttgcgcggtgtttccaaggattggacaaattcttcaatgctgtaagtgccaacaacattttttccttttgcctcctgtaaaaactcctcagttttactgcttgatctgttgtaaacagaaacagaaaatccccggctttcgatatttaaagccagatttttacccatgaccgcaagtccgataacgccgatttgttgttttgacatattctaacgtcccttctgcaaacgtttaatcattttaaaatttaaattaaaataaaatgatatttataataaagaaattaccatacattcaccctttttttcaagcgattcagcttttcttttcatcttgaaaaaaatctttattaaagcttgttccctttgttttgctctcctctttttttaacgttgccccttttctgatcagtttggtaccgtactttttattcaacttttccatcatctgctgaatgggctcatccttcgcatcttcattaaagctgaacaaatcgagctgtttataggcctgctctttttctactaaatccgttccggtaatgccaagcagcctgacaggatttttattccaatgtttaaaaaagaggtgctccgcttctttcaaaatgtcatttttttgatcaatcgggtttctcagcgtagtgcttcttgtgatggttttccaatccgcatatctaatcataataaaaagcttcgaagccatgacttccttgcgctgtaaacggtcactcacagaagcggcaagctttctaaagacgcctaacagctcttcttcatcactggaatcatgggaaagtgtcgatgagttgccgacgcttttaaattcgtaaatgcgctccgggtcaaccggcgcatggtgaatgccatttgctttatttttaaggcgcggaccgttgatgccaagcaggcgcttcagcgagtgttcatcagctgcagctagctctccgattgtatggatgccgagtcccttcagtttttccgctgtctttttgccgactccgtgcatctctccaacaggaagcggccacaggatatcaggcacttgcctctttcttaagatcgtaattccaagcggttttttcatatcagacgccatcttagcgagaaatttattcggcgcaatccctatgcttgacgggagcagcagctctttttgcagcctgctttggatttcttttgccgtctctagagcgcggctgctgtatggtgtatcggtcatgtccatatagccttcgtcgatggagacaggctccaccaggtcagtatattcacgaagaatggtaaacatcgctcgtgaagagtttctatagcggtcaaagttcggcggaagaacgatgagctcaggacaatggcgcttcgcttgccaaaccggcatcgttgttttgacgccgcgcgctcttgcttcatagctgcatgttaccacaatgccctttcgctcttttacgtttccggcaactgcgaccggctttccccggagagccggatcatatgccatttcaaccgacgcataaaagctattcatatcaatatggaaaataattcggctctttcccggcataaacaaatctccttttcggtcattagacaacagcttgtacatatagtaaaatgaagctattgaatggatgtgatgacaatgtttgtggaatcgataaatgacgttttattcttagtcgattttttcacaattattcttcctgctctaacggcaatcgggattgcatttctcttacgggagtgccgtgcgggcgagcaatggaaatcaaaacgaacagatgaacatcagacggtctttcacattaaccgaacagactttcttattattatatatcatcgcattacaacttggatacgtaaagtcttccgcatgaattcgcctgtgaacgatgaggaagacgccggttctcttcttttataaaccgcatttataaaaaggaggagaacaaaattgttaaaaacatatcaaaaacttttggctatgggtatctttttgatcgtattatgctcgggcaatgctgcatttgcagcgactaatcaggtgggaggcctcagcaacgtaggttttttccacgattatttaatcgaaccgttttccgctctgcttaagggtgttgccgggctgtttcacggagaatacggactctctattatcctcgtaaccattattgtgcgtatagttgtattgcctttgtttgtcaatcagttcaaaaaacagcgcatcttccaagagaaaatggccgttattaaacctcaggttgacagtatccaggttaagttgaaaaagacgaaggacccggaaaagcaaaaagagctgcaaatggaaatgatgaagctgtatcaggagcataatatcaacccgcttgcgatgggctgtcttccaatgctgattcagtctccgattatgattgggctttattacgcgattcgctcaacacctgaaattgcgtcacactcgtttctatggttcagtttagggcaatctgatattctcatgtcccttagtgcagggattatgtattttgtccaagcctatatcgctcaaaaactgagcgcgaaatattccgctgtcccgcaaaaccctgcggcgcagcaatccgcaaaattgatggtgttcatcttccctgtgatgatgacgattttctcgcttaatgttccggcagcccttccgctgtactggtttacaagcggactgtttttgacagtgcaaaacatcgtccttcagatgacgcatcataaaagcaaaaaaacagccgctcttactgagtcggtgaaataaaaaagcaaccccgtgcgaaaagccggggttgttttttgttacttgcaaagcataccgcgccaaacagtcttgattatcatggctgaagcagaaatggccatcctaaaaaatagccgtatcgtttaaaaagaaggagatcgggaatacctttactcacctccaaacgaaaggagcatatacgttgacggaacactttcagcaaaaaaacatttctgtacctgaaggaatctggatcatgagacaaacctggaatgatgtcttatttgctcactggcctgttgatgtttctatccttcgcgctttggtaccgtccgttttagaattagatacatataacgggcaagcttggatcagcatgcttccctttatgctcacgaacctgagggcgcgttatcttcctgccattcccggtgcgcgtgcatttcctgagcttaatctccgcacctatgtcacgtataaaggcaagcccggcatttatttttttagcttagatgccgatcatcgtctggcggtccttggcgctcgcacattctttcatctgccttatttttacgcggatatgaaagccgaaaaaaacggtgatgccattgactatgtcagcaagcggaaagatgacaaagaagcagcattccacgccgcataccggcccatttcagcgccttttacagcagaaaaggattcgctcgattactggctgacagaacggtacaggctctacaccacttatcgcaataagctctattacgaagacatccatcatcatccgtggctgctgcaaaacgccgaagcagaaatttcagtcaatacggtgactgatgctcacggcattacattgccagagtcagaccccttgcttcattacgctaaaaaacaggatgtgttattttggccgcttaggaaatggagctaaaaaacccgatgcgggaaatcgcactcgggttttctttttttattttgccgcctcttcaataatggcaacaaccatttctgccgttttaacgagctcttcgatcggcattttttcattttttgtatggatttgctcataaccgacagcaagattgaccgtcgggatgccatgaccagcgattacgttcgcgtcgcttccgccgccgctcgtttgcagctcgcttggacgtccgattttagcagccgcttttttcgcgatttcaacaacttggtcgccgtcttgatatttaaagcccggatacataacctcaatttcgacttctgcgcgtccgcccatatcagcagctgcctcttcaaaagcagctttcattttttgaacctgagcttccattttctcaggaactaaagagcgcgcttcagcaagaatatgaacttcgtcgcacacaatgtttgtttgtgtgccgccttcaaaccggccgatattagctgttgtttcttcatcgatacggcccaatggcatttttgaaatggctttgctagcgattgtaatcgctgaaatgcctttttcaggttcaaccccggcgtgagcggttttcccgaaaattgccgctcttaccttcgcctgtgtcggcgcggccacaatgatatttccaacttttccgtctgaatcaagggcatagccgtaggatgcagtgatcatagaacggtcaagagccttcgctccgatcagacccgattcttcccctactgtgatgatgaattcaatcgtgccgtgttcaatgttttcttctttcagcaccttaatcgcctcaaacattgcagccaatcccgctttatcatcagcgcctaaaatcgtcgtgccgtcagttttgacgtaaccgttctctacaactggttttacgccgtttccgggtacaactgtgtccatatgagatgtaaaatagatcgtatctgtttgttttgtcccttttagcgtgcaaatcaggttaccggctccgtggcccgtgatatccattgtatcgtcttctttaacgtccacacctaaatcagaaaattttcgtttcagcactttgcagatttcagcttcgtgctttgtttctgagtcaatttggacaagctctaaaaattcttccagcaggcgtttttcattcaccatttgtaagtccctccatattaaagcggtatgttaccgtgcttttttttcggtctctcttctgtcttatgtgcaagcatatgaaaagcttgaatcagttttccccttgattcttccggcaaaatgatgtcatcgaccattccacaagcggccgctttgtatgggccggcgttttgctttttgtattcagctgttttttcgcgtttcgtcttttgcgggtcagctgaagctttgatttccttttcatacaaaatcgatgccgcaccttctggacccatcactgcgatttcagcattcggccatgcaaacacaaggtccgctccgatcgctttgctgttcatggccacataggcgccgccgtacgcttttctaatgatgagtgtgacttttgggacagtcgcttcagcataagcaaacaataattttgctccatgtctgatgattccattgtgctcttgctgaatacccggcagaaaccccgggacatcttcgacagtcaatagcgggatatcaaatgcgtcacaaaaacggatgaaccttgctgctttatcagcagcgtcaatcgtcaggcttcccgccagatgcttcggctggctcgccacaatgccgattgctttttcacccagccttgcaaacccaatgacaatgttcttcgcaaaaaatggctgaatctcaaaaaaagactgcgggtcagccagctccctgatcaccttccgaacatcataaggctttgtcgtatcagcagggacaagatggtttaataatggtctggacgcctctttcgctggcttcggctctgttgtccggccattcagcggcaaataagacagcagttttctcacccctgtcagaacctccttctccgtatgtccggaaaagtgggcgtttccgctgacggcattatgtatccccgctccgcctaagctctccgcatcaacctgttcccctgtcactttttcaatcaccttcgggccggtaataaacatccggccggtctgttcagccataaatataaaatctgtgagtgccggagaatatacagcgcctccagcgcacggccctaaaataaccgatatttgcggaatgactccggaatataagacgtttcggtaaaatatgtgaccgtatccatctaatgataccacaccctcttgaattctcgcaccacctgagtcattcagcccgacaatcggcgccttattttttgctgccagatccatcaaagcgcagattttcctggcatgggtttcgccaagcgcccctccgtacactgtgaagtcttgcgcaaatacataaactgagcggccgtcaattgtgccgtaccctgtcacgaccccatcccctaacatgcgctgttctcttgttaacacttgactttccatgaaggggtgtaattcgataaagctgtcctgatctagaagaaatatgatcctttcccgagcagtgagcttgcccttttgccgctgctgagccagcttttcccgtcctccgccttcttctgcctgcttgcgtttcgtgtataaatgatccatgtgttcattcatgctcattgtgttggtctcctttcggttcacaaagctctacaagaacaccgtttgtttcccgaggggaaataaacgcgatctttttcccgttcgctccctgtcttggaaacctgtcaatcaattgaacatgctggtcagacaatgcttgaagctgttcagataggccgttgcacaaaaacgcaatatgatgcagtccctgccctttcttctccaaaaataaatggacggggctgtcagctgtcaacggctctatcagctcaagtttgacgctaccagcttgaaaaaaagcaacattcaccttttgctcttcaaccgtttcttgatgaagaaatgcaagccccaatacattttcataaaagcttcttgcatcttttatcgaaaaaacggctatcccgatatggtcaagcctgttcattttcatccctgctttcgctaatagatatcgcttgtccgcccattcaaaacacgctaaaatatagacagattgtttaaggagtgaaaatcatgtctcaaaaactgatgaaaagcgttttgatcgtgattttgggagtttttattctttcaactgtactctcaggaatcgtcatgtttctataacgataaaaaagcaggcgccttattcaatgggaatatcctgcttttttatcagagctttatgctcgatggcaatctcctcaaaagagcggttgtcgtccgtgatcagcactctcgttcctactggtatcgtttgaaacaaatgaacaacctcatcgttatgcatacgtatacagccgttagacacaaattttcctactgattcctctcggtttgtcccatgaattccataaatccgcccgtccgttcctttcgcgtcaaatccgatccatctggccccaagcgggttgtcaggagatcccccttcaatatttttctttctgtagtaaggattttccgcttttaccgttaccgaaaactctccttcaggcgtcaaatcatctgtttttccagtcgccacactatacacgccttctactctgttgtcgaggataacagcaagttcatttgttcgcttgttgacaataacatacggatcacccggcagcggattttcgccgagcggccaaatcggtgaaatcatcatgaaaatcgaacataagaaaaaacgcataagctcctcctttttcattaggttgaccaatgaaggaagagctcatgcgaatcatccgagtgatttttgcgcttttattcctttaaaataacttttaatcactaaatattgttccatttcgccgagaagatggaagagagcggccctcgcttcaaattcctctctagtcgcaggaagcggcatctcctcaaattcttttctcatgtcagcaagtcttttcagaaatttatacgctgtattcccagggtgtatcgcctcccgcaaatcatgaataaattcagcgatcatttttccctgatctaccgtgatggagatcgatgtcactttagggagaaggcgttcaataatttcaaattgcttttctctcattttaaaataatgataatgcagattttcataacgcaaaatgtggttttgcacatctcgatatgccaggtttttagcctccgtaatgagctggtgcgtttccggaatttcttttcctgaccaatcttgctcaccagttaacaaataccgttcgatttctgcaaaaatgacagcaaagttatcctctatctttttgcggtaggcaatcagtttccgatcaagactaggcatatacaagttcatcaatagagcgacgccgatgccaaccgtaatcagctgaacttcattccagatgaaagcaagcgtaatgccgccggacatgtataaatgaaggataataacggaactggtgacgataccctcgttaatttttaacagaaccgttatcggaatgaatatcaaaagaagcgctccgatcacaaacgggtggtagccaataagctcgaaaaagagataagaaaaaacaattgccagacagcatgccgcaaagcgggcccatgaggcctgaagcgaccgtttttgtgtgatttgtatgcacaaaatggtgatgattcctgctgatgcgaagttttgcaaatgcaataactggcttatataaatagccaaagctgttccaagcgcggtctttattgtgcggtaaccaattttaaacatgtcggactccatttctatttgtttcttcaataaaaaagaagaggcggccagccttcttcttttttatattctataatattttctctaaaaagtcctgcgctcttttggattttggcgacataaaaaattccttcggattgccgtcctcgacaatcattccttggtccataaacagcacgcggtctgccacttcttttgcgaagcccatttcatgtgtgacaatcaccatggtcatgccggtttcgaccagctctttcatcacctgtagcacttctttgaccatctccggatcaagggcggaggtcggctcgtcaaacagcatgatgtccgggttcatcgcaagagccctggcaatcgcgacacgctgtttttgtccgccagacaaacggtttggatagtcatttcgcttttcaaacaaaccgactttgcggagcaggtcctcagctttctcctgtgcagcctgttttgattctttttttacattgacaggcgcgtacatgatgttttcgagaaccgttttgtgcggaaagagatgaaaatgctgaaaaaccatcccgatgttttcccggacctttaatgtgttggtttttggcttcgtaatctctgtttcttttattgtaatggttccgccgttaggcttttccaacaggtttaaacagcgtaagaacgttgatttgcctgagcctgaaggaccgatcacggcaacaacctcaccctcagcgattgttgttgaaatgttttttaatacttcgtgtttcccaaatgattttgacagcttttcaaccttaatcattggatttcagcttcctttctacagccttgccgataaacgttaaaatcaggacaagcacataataaatcaatcccgcgataatgagcggctcaaggtaattgtaagtggcggcgccagcttgatatgcgcgtctcatgacatcaccaagcccgatgacggtaacgatcgccgattcttttgttaacgtaattaattcattcacaattgcaggtgatatatttttgaaggcctgcggcagcagcagatccttcatcatttttccatacgggacaccgagtgcaacagcagcttctttttgccctttatcaatggcattgattccggctctgataatttccgatacataagcggcggaattcaaagacaatgcgacaaccgcagcccaaaactggtcaatttgaaatccgagcagctgaggaaggccaaaatagacaatcataagctgcagcactaaaggcgtgcctcggaacactgatgtataaaaatcagcgatccagataaacgggcggaatgtgctgatcttgcataagcttagcacaataccgagtataagtccgataatagcagatacaacaacaatttttaatgtaattgccaagccttctaatataaaaggaatttgggggatcgttgctgaaaaatccaaattcatagcctttgtctccttttcttacaggaaaaaagtttcctattcaataaaaaggctcaacgaaaaagttgagccgcttttttttacttctcgccagtgaaccattttttcttcaatttctcaagctctccgttatcttccatttccttgagcgctttattgaatttgtctgtcagttcactgtcctttctgaaagcaattgctgaaccggcttcttccgctttcgcatcaggaatcacaaagccttgcaggtcatcatttgatttgaaatacccttctgcaacaatgtcttcaattatcgcggcatcgaaacggtcagatttgatttcctgcaccaaatcagaaattctgttgcggtcttctgttttaaaaccatattccggagaaagctctttccccttctcttcctgaatagagccaagctgaacgccaactgtttttcctttcaggtctttcaaagattgaatgccgctgtcttttttgctgacaatcatatggttcgctgtgtaatacacatcggaaaaatcaacttgttttttacgctcaggcgttggtgtcattcctgacagaacgagatccacctgttttgatttaagcgctgtaattaagctgttgaagtccatatcctgcacttcaatttcatagcctgccttctttgccagagcttttgccagctctacatcaaagccgacaatattatctccttctttatattcaaacggtttgtaatccgccgaagtacccataattaattttttctttccgctttctgaacctgaattgcttgagccgcacgcagttaatgcaaaggtgatgcaagcagctacaagtaataagagccattttttcatgatccatttcccccgtattcattacttttggtgtatttgaatatttattcgttaatttgtattttaaacagtttctcatttttatgcaatactatttttaaaaattatctttaagcttatctttccagtgatctcttctgatattactagataaaaattaaatcgctgtacaatccgattgaataatcccttaatatttattcatatatccttggaaatttatgcacaaaaaaacccgggctgctttgagcatccgggttgttcgtcttatacttcttcacaatattcttcaaaggcttcctgcagctttgccactacggccatcggctcatggccttcaatttcatgacgctctaccattttcatgatctttccgtctttcaaaatcgcaaaggacggagaagatggcggataaccttcaaaatagtcacgcgcacgcgctgtcgcttctttatcctgtccggcaaaaacggtgacgagctgatcaggtcttttatcatagtgaacggaatggtaggctgccggtcttgcaattcctccggcgcatccgcaaacagagtttaccatgacgagcgtcgttccttttttcgtaagtgcctcatccacctcttcggctgttttaagctcggtatatccggcagctgttatttcttgtctcgcttggcggacaatatcattcataaataaattaaagtccatgttcaatgaagacctctcctttttcatcatctgttcttatgatagcaaggaaacgtccatatcggcaaatgactttgcttcgccgtgcactttttttgctcttcgtttactgcttacagaaaaggggattatataactagaagtaaaataaaggagcagttgtatatgagccacaggaaagcgttactgattcataacggaaatgccggcaacaaaaatatagaaaaagcacttggtgctgtggtgccggttttatctcacgatttagatgaggtgattattaagcagacaaagaaaaaggatgatgcgtatcatttttgccgatccattgatgattctgtcgacaccgtcttcattctcggcggcgacggcacgatccatcaatgcataaatgctatcagcgctctagaaagaaaacccgctgtcggaattttgcccggcggcacgtgcaacgacttttcaagagtgcttggcatccctcaaaatcttgcaaaggccgcggaagcacttatggcaggaaaaaaaaccagcgtagacgtatgtcagatgaatgaccgttattttttgaatttctgggggatcggcttaattgcagaaacgtcgaatcaaatcaacgaaacggaaaaagcattattgggaaaaatcagctattttacaagtgccttgcgaaccgtctcatccgctgcatcgtttccgatgacattaaaaattgatggagaagaaattaaagaagaagccgttatgctgcttgtgatgaatggccaatacattggaacgaatcgaattcctctgcccgatgccagtattgaagacggcttacttgatgttctcatatgccgcaacaccaacctcaccgcgctgcgggagctgatgagcatggaacagggctcaattgatcgttttaccggagagctgtcctatgtccaggcctcccgtatcgagattgaaacagacactgccaaaaaggcggatatggatggagaagtttatacacatacacccgcagtcattcaggtcctgccgcagcatatcgacatgcttgttcccgcaaatgaataactgtcataaggctttagaaagattttgcaaatccgttgactctcccctaggaggaggtcttacagtataagggatacacacttgaaaaaggggaagtcatatggagaagaaaaatattaccttaactatattattaaccaatttatttattgcttttttggggatcgggcttgtgattccagtaacgccgaccattatgaatgaattgcatttatcagggactgcggtcggctatatggttgcctgcttcgctattacacagctcattgtctcaccaatagccggacgatgggttgatcgcttcgggcgcaagatcatgatcgtgatcggcctattgttctttagtgtgtcggagtttttattcggcattggaaaaacagtggagatgttatttatctcccgtatgctgggcggtatcagcgcagccttcattatgcctggggtcacggcttttatcgcagatatcacgaccattaaaacacggccgaaagcgctcggttatatgtcagccgctatttcaacaggatttattatcggccccggcatcgggggatttttagcagaggtccattcccggctgccttttttctttgcggcagcttttgcactgttagcagccattttatcaatcctcacgctgcgcgagccggaacgaaaccctgaaaatcaggaaataaaaggacagaagacaggctttaaacggatttttgcccccatgtatttcatagcttttctcattatcttaatttcgtcttttggtttagcatcatttgaatctttatttgcattattcgtggatcataaattcggttttacggccagcgacattgccattatgattacaggaggagcgattgttggcgccattacgcaagtcgtcttattcgaccgcttcacaagatggtttggcgaaatccatttaattcggtacagcttaattctctcgacgagtctggtattcttgctgacaacggtacattcatatgttgcgattctgctggtgacagtcaccgtatttgtcggattcgatctcatgcggcctgcagtaacgacttacctgtcaaagattgcgggaaatgaacaaggatttgccggcggtatgaattcaatgtttacaagtatcggcaatgtattcgggcctattatcggcggaatgctgttcgatttagatgtaaactatcctttctactttgcaacggtcaccttagccatagggattgcactgaccattgcttggaaagcgcctgcacatcttaaagccagcacgtgataagaagcgtattctttgtgtactgcaaagaatgcgcttcttctttatactgatgacagaaggagtgatggcatgaaggaatcgtattactcaattggggaagtatcaaaactggcaaacgtgtcgataaaagcgctccgttattacgataaaattgatttatttaaacccgcctacgtcgacccggataccagctaccgctattatacagattctcagctcattcatctggatttgatcaaatcattgaaatatatcggcacacctttagaggagatgaaaaaagcacaggacttagagatggaagaactgtttgctttttatacagagcaggagaggcaaatcagggagaaattagactttttatcagcactggagcaaaccatttcattggtgaaaaagcggatgaaacggcagatggaatatcccgcgctcggtgaggtgtttgttttagatgaagaagaaatacggatcattcagacagaggcagaaggtatcgggcctgaaaacgtgctcaatgcctcctacagcaaattaaaaaaatttatcgagtcagcagatggatttacgaacaatagctacggtgctactttctcttttcagccctacaccagcattgatgaaatgacttaccgtcatattttcacgcctgtattgacgaataaacagatttcatcaattacgccggatatggaaatcacaacaatccctaaagggaggtatgcgtgtatcgcgtataatttttcgcctgaacattattttctcaacttacagaagcttatcaagtatatcgcagaccgccaattaacagttgtcagtgatgtatacgagttaatcataccgatccattactccccgaaaaaacaagaagaatatcgtgtcgaaatgaaaatacgaatcgctgaataatagaaaaagagcattttttgaaacaaaacttcaaaaaatgctctttttgcttatttagtaaacagatgtcttctcgtcaatcgattctaaaatttgtttcactcgtccgaggaatcgtccgcacacgagaccgtcaagcactctgtgatctaatgacaggcacagattaaccatgtctctgacagcaatcatgccattctccatgacaaccgggcgtttgacgatggattctacttgaagaatcgcagcctgagggtagttgataatgcccatcgactgaacagagccgaacgaacctgtattgttgacggtaaacgtgcctccctgcatgtcatctgcagtgagttttccgtctcttacttttttagctaggccggtaatgtctttcgcaatgcctttaattgttttttcatcagcgtttttaatcaccggaacaaataaagaatcctctgtggcaactgcaattgaaatattgatatccttcttctgaataattttgtcccccgccacatgctattcatttgcgggaattcttttaacgcctgagcgaccgcttttacaaaaaaggcgaagaacgttaaattaaagccttctgtcttcttaaaggaatcttttatactgttgcgatatgcaaccatatttgtgacgtcgacttccatcatcgtccaagcatgcggaatttctgttttgcttcgcttcatattggaagcaattgcttttcttacacctgtgacagggatttctttatcaccggctgcagacgcaggatatgacgtctcttcttttggctcaggttttgatgcagacttcggtgcaggagctgctgttttcggctcctcagccttctgttcttgtacgccgcctgtttcaattaagcgctgaatatcttttcgtgtgatgcgcccgccagcacctgttcctgttacttgatcgaggtcaatgccgtgctctccggccaaacggagtacagctggcgagtagcgctttttattgggctgatcagctgcttcggcactttttgcagcaggcgtctcagcggcttttgaagcagctggctgttcttgtttttgttcagccggattcgcgccttctgtttcaattttgcaaatcacttctccgacttgcaaggtttggccttcttctcccacaagctctgttatcgtaccagtaaaagaagacggaacctctgcatttaccttatctgtcatgacttccgcgattggatcgtatttgttcactttatcaccgggggcgacaagccatttgctgatcgtcccctctgttacgctttctccaagctgcggcatcgtcatttgttcaattgccatgattttatcctcccttacgtctttaaaactccgctaattctctcatcgccgcttccactttatcagggttgaccataaagtatttttccattgtcggcgcataaggcatagccggaatatcaggacctgcaagccgtttgattggcgcgtctaagtcgaacagacaatgctcggatataattgcggctacttcgctcatgatgctgccttcttttgtatcttctgtgaccaaaagaacctttccagttttggacgcagcttcgatgatggcttctttatcaagcgggtaaactgttcttaaatccaccacatgcgctgaaatgccatctttttcgagacgttctgcagcttgtaaggcgaagtggacacacagaccgtatgtgatcactgtgatgtcgtcgccttccctttttacgtccgccttgccgattggcaggacataatcatcagccggaacctcgccctttatcagacggtacgcccgcttgtgctcaaaaaacagcactgggtcttcgtcacgaactgccgcttttaatagacccttggcgtcatatggtgttgatggcatgacaattttcagtccgggctggttggcgaaaattgcttcgactgattgagaatgatacagggctccgtgcacgcctccgccgtatggcgctctgacgacaatcggacagctccagtcattgttgctgcggtagcggattttagccgcttcagaaataatttggttgactgccggcataatgaaatcagcaaactgcatttcagcaatcggtctcattccgtacattgccgctccgataccgactcctgcgatcgcagattcagcaagcggcgtatccataacgcgctcttccccaaattgttcatagagtcccgctgtcgctttaaacacaccgccttttcttcctacatcttccccaaggacgaaaacgcgagaatctcgttccatttcttctttcatcgccaaattgattgcatcaatatatgacattactgacatttgttcttcctccctacttcgcatacacataatcaagcgctgactcaggagctgcatatggggcgttctccgcttcatccgtcgcttcatttacgattgccataatttcatccagcatggtttgttctatctcatcggacagcaggcctgtttcctttaagtaagcttgataagtaagcaggggatcactttttttcgcttcctctacttcttcacggcctctgtagctgctgtcatcgtcatcactggaatgtggtgtaaggcggtaagaaatcgtttcaattaatgtcgggccttctcctctgcgtgccctttcgcgtgcttctttaaccgcttgataaacttccagcggatcatttccattcacagttacgccaggcatcccatagcctatggcacggtcggaaatgttctcacatgcgacttgcttatcgtaaggcactgagattgcgtatttgttgttttcacacatgaaaataaccggcagcttatggacagcggcaaagttcgccccttcatggaaatcgccttggtttgaagacccttccccaaatgtaacaaaggctgcgatatcctttttctccatacgtcccgcaagcgcaataccgactgcgtgcggcacttgcgttgtaaccggagatgatcccgtcacaatgcggtttttcttttgtccgaaatgtcccggcatctggcggcctcctgagttcggatctgctgcttttgcaaacccggacatcattaagtcctttgctgtcatgccaaacgcgagcacgacacccatgtctctgtagtacggcaatacataatccatttcacggtcaagtgcgaaagccgctcctacctgtgctgcttcctgtccttgacaagagattacaaatggaattttgccagaacggtttaacagccacattctttcatcgatttttcttgctaacagcatggttctatacatatcaacggcttcctgatcagtcagccctagtgcttgatgtcggtttgtactcattcaagcccctcctttatgcttttaaaaatgaatggctttgccatctgcggcaagcgctgcttctccaattgcttcagaaagcgttggatgcgggtgaatcgtttgcccgacctcccacggtgttgcgtccagcactttggcaagacccgcttcagaaatcatgtcggtgacatgcgggccgatcatatgaacgccgagaatatcatctgtatctcggtcagccacgattttgacaaaaccgtcgctttcaccgtatacaagcgcttttccaatcgccataaatgggaacttgccgattttgacattatgcccgttcgcctttgcttcgtcttcggttaagccgacactggcagcttcagggcttgagtaaatgcacttcggcacaagcgtcggatcaagcagatgcggattgagacctgcaaaatgctcaacagcaataattccctcatgtgaagcaacatgagctaactgcaggccaccgattacgtctccgattgcataaatatgagattccttcgtttggcagctttcattgactgaaatcatgccattttcagtaacaatatcggtgttctctaggccgatgccttcgatatttgcctgtctgccgatggaaacaagcattttctcagcagagtaggtaacggtttctccgtctttttccgcttgtatgctgatatcgtctgatgtttttgtcattgtgtcaggcagcacttttgcccctgttatgaactggatgccttttttcttaagaagactttccatttcttttgaaatctctagatcttcagtcggcaatatgcgatccgcgtattcaataaccgttaccttcacaccaaaatcatgaagcatagacgcccattcgataccgataacccctccgccgacaatgatgattgattgtggcagctcctccatttggagcgcctcatctgaagtcagtacagacttaccgtccgcttcaagacccggaagcattctcggtcttgatcctgttgcaatgatcacttgtttcggtatcagcatgtcattttcttcaccatttccccgctcaacagaaattgttcccggcagcggagagaagattgacggtccaaggatacgtccatatccggtgtacacgtcaatttttccttttttcattaaatgatttacacccgctgcaagcttatcaacaacggcttgcttacgctgctgcactttttcaaagttgagggacacgccagccgtttccactccgaattgatcggcttcacgagctgtccggtatacctctgcgcttctaagcagcgctttactcgggatacagcctttatgcagacatgttcccccgagtttttccttttccacaacggctgtttttaagccgagctgagcggctctgatggccgcaacataaccgccggtaccgccgcccagaatgactacgtcatactcagttgccatggtgactcactcctgtctgtctattcaatacgatattgtttggattgctcttcgccctgcaatactctgagcgccccttgggcaagagactgcagttcattttcacccggatagactaaaacgtctgaaatccaatctatgtatgatctgatagcagaaacaaaactttttccgtacgcaaggcctcccgtcagcacaatcgcttcaacttcgccttttaacgccgcgctggctgccccgatttcctttgctacctgatatgccatggcatcataaatgaagcgggctttttcatcgcccccttgaatcatctgttccacttttactgcatcatttgtaccgagatagcctaaaagtccgccggtgccaacaagctttttcatgatttcttcttttgtatattcccctgaaaaacatagatcaacaagatctcccgcaggcactgttcctgctcgttcaggactgaatggtccctcgccgtgcaggccgttattgacatccaccactcgcccgcggtcatggacgccaattgtaatacctccgcccatatgggtaataatcattttcatgttctcatatcgtttgccaagagaggctgccgctttacgagcgacagctttttggtttaacgcatggaaaatgcttttccgttcaatttcaggcatgcctgaaactttcgcaagcactgacatttcgtctacgacaacagggtcgacgatatacgaagggatattcaggccgtcagcgatttcccgcgcgataatgccgccgagattagaagcatgctgaccggcgtagccgcttttcaaatcctcaatcatctcatcattcactacgtaggtcccgccttcaattggccggagaaggccgccccttgcgcagactgcatcaaactttgaaatattgattccctgttcatgaagcgtttcgagaatatggtttttacgaaattcatactgatcaataattcggtcaaatcgctgcagctcttctatgttgtgtctcaatgttttttcaaaaatgcttctttcgttatgaaaaacaccgattttcgttgaagttgagcctggattaattgtgagaatgcgtttttcgtcatgtagcactttcataacctccagatcaatttcttaacgtctgcttaatacactgtggccgttttgcaaaaactggcttcttgagcggcgcatgcgttcaatacgttcctctgccaagcggtcagccgctaaatatgcaggaatgccgtcacgctgagaaatctctagtacacgctcgatattgccgtaaatgccttcaacttttttcaatgcacgttctgcattatagccgtaaagctcatctgccacgttgataacaccgcccgcgttaatcacgtaatccggtgcataaacgatgcccatttcgtgaatttgatcaccatggcgtgtctcttttaattggttgttagccgcacctgcgatcactttcgccttcagctgtttaatggtatcgtcgttaatagtcgcaccaagggcacacggcgcataaatatcgcagtcttgtgaataaatatcatcaggatctaccgcacgggcgccaaaatcttcaactgcacgctgtacagattgtttgttgatatccgtaacgattaagtttgctccttcttcatgcaggtggcggcaaaggttataggctacgttcccaacaccctgtacagcaatggtttttccttcaagagagtcggttccgaaagcagctttagctgctgccttcattcctctgtacaccccgtacgctgtgactggggacggatttccagaagagccgaaagcaggagaaatccctgtaacgtagtctgtttcatcatgaatgatatccatatcctcgaccgttgtgcccacatcttcagccgtgatgtatctgccgttcagcccttgaatatagcggccaaacgcgcggaacatttcttcatttttgtctttgcgcggatcgccgataatgactgtttttccgccgccaaggtttaagcctgccgccgcgttcttataggtcatgcctctagccaatctgagcgcatcttcaattgccgcttcttcattttcatatgtccacattctcgttccgccaagcgccggaccaagcgttgtatcatgaatcgcgataatcgcttttaatccagattgttcatcctggcagaataccaattgttcgtaatcgtatttctccatatatttaaaaagttccatgttcgttcctcctaatgtgtgtattcttcagatgcgcatattgccagcgcaatggaatacagtttattttcagcagagtccgctctgcttgttaaggcaatcggtgctttggctcctgtaatgacagccgccacgctggccttggcaaaataaatcagagatttgtataaaatattgccggcctcaattgttgggacgagaaggatatctgcgttgcccgctacgtctcccgaaatttttttctgggccgcggcaatttgagaaactgcgttatccaaagcaagcggtccatcaacaatgcagcctttgatctggccccttttgtacatttgagctagagcagctgcattcacggtcgcttccatcttagggttcaccgtttcgaccgctgcaagggcagctgcttttggcttattgttccccactgcatgggccacatgaacggcattttgcaaaatctgccggagctcttccagcgaaggagcaatattcattgccgaatctgtcacaaacatcagccggtcaaaatccggtatatcgaagacagccacgtgggaaaggacacttgctgaccgaagcccctcctgtctgttcaataccgctttaagcaaaacagaagtcggcacattgcctttcattaaaacgtccgctgttttatgatgcacagcacgaaccgctaatttcgccgattcctcaggagtatcggcatggacgatttccacttgatgcccttgcatggatgatgtcagctcgttcagttttgtgctgtcgcccgttaacaagaaacgggcggataggtgctcggctgccaactttacagcccggatcacttcctcatcctcagcgtgagcaaccgcaatggtcttatttttgtgtatcgacgctttgccgattaaatctttcagcttcatctgttaccacctttcttgtttcgactccgcctttttttatgcaagttccatgccagctcttaagggtgctgtcataccaggtatattgaaacattcgtgcagatgtttgcgtttattctgcaaattattgcatgccttcatttgcaaggccatatttatccattttgtaatataagttccgaatgctgacaccgagagcttttgctgtttttgtccggttaaaatgatgcttttcaagcgtttgctggatcaaatgtgcttcaaatttttctactgcgacagacagcttttcgccttcaatatccggaaaatcaaaacctgttccctggtctgtgtcattttctttttgctcaagttcgaatacaggcaagtgatctttttcaatccattccatatgcggattcagaaaaatcatggctcgtccaaggacattttcaagctcccggacattcccaggccaatggtaggcagataaggcgcgcaaggcttgctgtgagagcccttttacattcctgccgtaatcccggttgatcttttggataagtctgacgctcagtgcttcaatgtcctccaaccgctgacgcaaaggcgggatggagatcggatagcggttgatccggtaatacaggtcttcccggaacgttccgtccgccatcgccttttcaatatttacatttgtcgccgcgatcactctgacgttgacagggatcgctttcgtgccgcccactctgacgatttccttttcttgaaggacgcgtagcaatttggcctgcatattttgtgtcagctcaccgatttcatctaagaaaatactgccgttatttgcttcctcaaataaaccctttttaccgccgcgcttcgctcctgaaaacgcgccatcctcatagccgaacaattctgattcgagcaggttttcagaaagggctgcacaattcacgcgaataaatttattgtatttccggtcactttcgttatggatggcatgggcgaacagttcttttcctgttcctgattccccgcgcagcaagatggttgccggtgttttcgcaccgagcttcgcctgctcaagcgcaaccagcatttgctcgcttttgccgataatgtcgtcaaacgtgtatttcgcttcaagcgtgcgaataatttgtctggcgcgattaagctccgctgtcagcattttaatttcggaaacatcgtgaatcacgccgacgctgcctttcaaaatcccatccacaatcaccggtgctacattaacgatgacctctttttcattcgggccgaccttcattctgacaccgcgaacaggacgtcttgtttcaagcacctttaaatgcatgctttcgccttcggaaatatcagtgtttgcaggcttgccgatgacttctttttcagaaagccccgtcattttcgtatacgctttattgattagcaggccgatgccgttttcatcaacgacagaaatcgcctcatcggaggattgaataattgcctccagcatcgtacggacctgctttaagttggtcacttcctctgccagctcgaccgcatcagtgatatctttaaacacacaaagagccccgagcagacgtccgccttcatcaataatcggcagccttgtggtcacaatttgcaaatgatcgcctaacagctgcttctggttgtattcaggcactcttgtttttaagatccgcggcatcttagtgctcggaatcacttcttttattgggcgcccaatgacttcctcacgttttttcccaaccattttttcggccatatggttaaagagaatgatttcttcattgatatcaataaaaatcattccatcatgggtcgaattaaaaattctgtcatatttataggtttgctcttttagcatttgaatcaggtgctgcttttcttccatcagctgaaaaacgatgtatgccatttttcccggcatgacaatggtatcttcatgctttctttgaaggagctcgtcaaacacggcttgatcgccggtggtatgaatgacgatatccggttgttgttgtatgtaaggtttccaatcagatgaaacggcaatcccatactgttctgcttctttcaatcccggcgcctcggggtctttgtcaactacggcaatgatatctatgatggctgttttaatcagaatatgtaataacgccgttccccttttgccggcacctactatcagtaccttttgcatcccgatacccctttgtatgaaaaaatttgcacacctatttattccgttgcaataatttgcacaaccctatgttaccacgttttcttctcttgacaaaatattttttccgctggacaataaaggaaatgaaaagataaaggggttttctgaagatgagccgacttcttgcgcttttaatattagtcatccccggggctatttctgctttaggcattaaactgatgagagatacacttttcggccatacaatcaagccattttcagctctttggctccaagggttgtcaggattcatcttttttgcgatcggcctctatgtgctggccgggttcattttatacagagacagaaaacgcaatcaagtcagcccgcgattcagaaaacgatagcttcaaaaaagccggagaatgctccggctttttttgttgcattattcgtcaggcaaaacggtcttggcaatcgttttgtctaacgcttcatagtcataataagaaatcgtatcgtacagttcttttcgtgtctgcatatcatgaattccttctttttgtgagccgtgctccttcatcaaaccaaacatccgctcacaagcttttgccgccgctcgaagcgaggtgacaggatatatcaccatgtgaaaccccatatcttcgaattcatcggcacgataatacggcgttttcccaaattcagtcatattcgcaaggagcggaacggagatacgctcagcaaactggcggaattcattctccgcctgtagcgcttccgggaaaattgcgtccgctcccgcctcaatgtaagcctctgaacgttttattgcggcatcaagcccttcctgcgccctggcatcagtacgggcaacaacaataagggagggtgccgtttgtttaatggcttttattttttgcgccatttccttgatcggaactagctgcttgccatttaaatgtccgcatttttttgggagctgctggtcttctatttgaacggctgctaccctggcttcaagcatttcccgggctgttcgggcggcatttaagacaccgccaaatcccgtatcgatatccacaagcagaggcagatcagctgcacgcacaagatctttggcccgttcagctatctctgccgatgtgatgatccctagatcaggcagccccctgctggctgtataggcagcaccggacaaataaatagcagaaaaaccggcttctttcgcaagcaaagcggccatcccgtcatgggcgccgggaatttgaagaatgtccggtgctgacatcagcttgcggaaacgcccggcaagctcctcttgtgacgattgctgattgacgatccacgacatgaaacaaatcccccttttacatgcagaacatgtctacgaattcatttacgcgcatcgtttgtaatgtctcatagctggtacagcgctcataaatgtgtttgtgctgtttatcaggaaaatgggttttgagattgtcagaaaacttttccaacagtttcggcactgcttcctctcttcgaaaacgatggccgaggggaaactcacattccaccatttccgtgctcgttccgtctttaaaatgaacctgaacggcatttgagatggaacgtttatcaggtttcaaataatcctcggtatatgttttattttcagtcacttccattttatcacgaagtttatctattctcggatcactcgctgtttcagcttcataatgctgtgcggtgatatcaccaaaaagcaaaccgattgctgtaatgtattggagacagtgatcacggtctgccggattatggagcgggccttttttatcaatgattcggatagcggattcatgcgttctgatgacaactcggtcaatctcatcaatccggttctttacctgcgggtgaagaatgacggcgcactccgccgctgtctgggcgtgaaattccgcaggataagacactttaaataacacattttccatgacataagcgtcgagcggacgggcaagctcgatctctttcttattgaataaaacgtcttggaacccccaacccggtgcactcagggctgtcggataacccatttccccttttaacgacatcagcgccaaatgaacacctctgctcgttgcatctcctgccgcccatgatttacgcgagcctgtattcggtgaatggcggtatgtcctcaatgctgcattgtcaatccatgcattcgaaagcgcatttttgatttcttctcttccgccgcccaaaagctttgccgcaacagcagttgtcgcaactttgacaaacagcacatggtcaaggccaactcgatttaagctgttttctaacgccagcacaccttgaatctcgtgtgctttgatcatcatctcaagtacgtcacgtactgttaacggctcttttccttcagacagcctcactcttgatacataatcagcagcggcaaggatccctcccaagttatcggacggatgcccccactccgccgccagccacgtatcgttgtaatcgagccagcgaatcatgcagccgatattaaacgctgccctcacaggatcgagaacatatgacgttcccggcactttgcttccattcggcacagtcgttcctggaacaatcgggccaagcagctttgtgcattccggataccgtagcgccaagatcccgcagcccagggtatccagcaatacatgccccgctgttgtatacgcttcggcacttgtaatctctttttcaagcacatagtctgtgatttcttcgataacacgatccgttttcggcattctaccagttcctttcatggttttgtttgatatcgcgggcccatgtaactgacacggggacggaagagccgattattggcatgctgttcgatcacatgggcgcataaaccggacgttctcgcgctgaaaaagaccggcgtatataaaggaatcggtatgccgagcatccaatacaccggggcagcatagtaatccaaattcgggtaaagccctttttccttctccatcagccgctcacccgcttcacacaactcatataaacgatagtcaccggctttatcgcataattgctgcagcgcctctttcatcatgagtgctctcgggtccatttttttcatatacacccggtggccgaagcccatgattttttcttttcttttcagttttgtttgcagaagctgctcaaaatcagatgtcgtttttgcctccaaaagcaaatacatcacagcttcgtttgctcctccgtgaagattccctttcagggaagcgacagccccagtcaaagccccataaagatctgaatgtgtagatgcaatgaccctggccgcaaatgttgaattcggcatctcatgctcactgtacaggacgagcgaccggtcaaaaatctgttcttccaatgaagacggcaatttccctgtcatcatgtatagaaaattcgcactgtaggatagggtatgaagcggaagaatcggctcttttttattaatgatcctgtagctggcagcagtgagggcaggcattttcccaagaagctgataggcgcgttctttgtttgcggaaggagaccgatcatcaatttgccgatcatagccagcaagtgccgacaggccggtacgcagactatccattggatgagtgccctcagggagcagctcaagcagacggagatgatcagcaggcaggcttgaggcactgtttattttacgttccagcgtctccatttcactttcttctggcagcctgccctccagcaataaatggacaagctccagatagctttttgtttcagaaagttctattaaatcatagcctcgtatcaaaatctggctggactgggtgtcaagataagaaatatgagtttctgccgcaatcacaccgtccaaccctggagaatattgctgtttctcctccatatcctcaacctccgtttttgcgttttttgtctatcaggttccgccaagcaaatacttggaaataatcagtctttgaatctcattcgtcccttcatagatttgcgtcacctttgcatcgcgaagcaagcgctcaactggataatccttcatatagccatatcctccataaatttgaacggcgtctaacgctgccttcacggctgcatcggaagcaaattgtttagccatagacgcttcttttccacaatttaggccgcggttatgaaggtctgcggcgtggtagacaagatgccttgccgcctctgccctagtcgccatgtcagccagcttaaatgatatgccttgattggctgcaatcggccttccaaattgcactcgctgcttcgcataattaacggcatgctcaagagccgcctctgcaattccgagggcctgtgccgcaatgccgatccggccgacatttaaattcgccatcgcaatgtgaaagccatcaccctctttgccaagcaaattggcttcaggcacttctgcattatcaaaaatcagttccgtagtattggagccataaagccccagctttctttctttttttccaacggtaaaaccgggtgtgtttttttcaacaataaaagccgaaatcccgtacctgccttgatctggagctgttaaagcaaatgtgatatagatatcagctgctccgccattcgttatgaatattttcgatccgtttaatagatatttgccgttctttttgattgctgttgtgcggaggctcccagcatccgacccgagtgaggctccgttagtgcaaatgcgcccaaatggtctcctgacgcgagctttggtatatatttcatcttctgttcttcgttgccgaaatacagaatcggatttgtgccgactgaggtatgaacggagagaatcacgccgacagccgcgctgattctagaaatctcatgaattgccaaaatataagaaacaacgtccgctccggcaccgccgtattgttccggcaccggtattcccatcaggccgtgttcacccatttttttgatcagctgaaagggaaattcgtccgttttctccatgatttccgcagcgggagcaatttcttttcgtgcaaaatcacgcaccatttttcgcatcatgacttgctcttgggttacatgcaactcggccacccccggatggaatagacttcaggaagtcctctcctcatagtcataaaaaccgcgtccgctctttttgccaagccagcctgctttgacatacttgcggagcagcgggcaaggacggtatttggaatcgccaaggcctgagtgaaggacttccataattgataaacacgtatccagtccgataaaatccgctaatgcaagcggacccatcggatgattcatgcccagcttcatcacttcatctattgcctccggcttcgccactccctcatacacgcaatagatggcttcattaatcattggaagaagcacacggttggaaacaaacccaggaaaatcattgacttctaccgctgttttccccatcttttccgctaatgccataacatctaaggccgtttcttctgatgtagctaagccgcgaatcacttcaaccagcttcattacaggaacgggattcataaaatgcatgccaataacccgttgaggccggtttgttacagcagcgatttctgtaataggcaaggaagatgtattgctggccaaaatcgtatgaggcgggcaaatgcgatcaagtgttttaaacatctcagtttttgccgccatgttttctgcgatagcctcaatcacaatgtccgcatgctctgcctcctcaagcgtttgagaaatcgaaatgcggctgattacgctcttcgcttccgtctcggtcctttttcctttctcagcatcacgggccagctgtttcttcagccgtttcaatcctgcctcagcggcctctggattcacatcatacatccgcacataaaagcccgcgccggcagctgtttgagcaattccgcttcccatctgacctgcgccagctaccatgatttgtttgatttccattcaaatcccctttttcatcatgttttaatgaacctgcactaagacggcgtctccctgtgctgccccgctgcaaatagcggcaacgcccagaccccctccccggcgctttaattcataaacaagcgtcatgagaattctcgccccgctcgcgccgatcgggtggccgagcgcgatcgcaccgccattcacatttactttttcaagatcgaaacctacgattttttcacatgtcaaaacaactgaagcaaaagcttcatttacttcaaacaagtcaatatcttggacagttaaaccgttctttttcaggagcttgttaatggcaaaccccggcgctgccgccagctcatgcgctggcattcccgtagttgaaaaaccaagaattgtagccagaggccgtttgccaagctcagcagctttttcctcagacatcagcacgaacgcgccggctccgtcattgaccccgggagcattgccggctgtgatagaaccgtcacttgcataaatcggagcaagtttcgcgagctgatccagacttgtgtcacggcgaatcgcttcatctttatcaacaacgtttggtttcccttttcggccgatccagttgacgggaacaatttcatcctgaaacttcccttcatcggctgccttagctgcccttgcatgacttctcaacgcccattcgtcctgctctcttcgtgagattgtaaattccttggccgctgtatttccgtgaacagccatgtgcacctcgtcaaatgcgcacgttaatccgtcatacaccattaagtccctaagctcgccgtcccccatccgtgctccccagcgcccggcgggaacggcatacggaatattgctcatgctttccatcccccccgcaacaagtatgtccgcatcctgcgcccgaatcatttgatcacataaagtgacagcgcgaaggccggaagcacagactttattcagtgtttctgacggcacactccaaggcattcccgccagacgggcagcttgacgggaaggtatctgccctgagccggcctggacaaccatgcccatgacgtttccttctacatcatctccagagactccagcccgttgcagcgcctccttcatcacaatgcccccaagctcagcagctttcacctctttcaatactccgccaaatttgccaaatggcgttcttgcagcacttacaatgactgttttcctcatggtttcacctcattcagaagatagacagcgcttacaatttctagttgtcttctatgaatgtatgctttgaaacgggcatgaatgaatgaaaaaagaaggctgcgtcaaacagcctccttctaacaactattcatttttcagcaatgccgaagccttttctggaaagtcggtaaacatgccgtctgctcccgcttcaatgagacgcttcatatcttccggacgattaactgtatacggccttaccttaatcgaactgttcctcattttcttcagcacttcatctgtgacccctgggctgtttagcttcgggtgatagccggaagccggaatagacgcgatatatcgatctgcctgataaagcacatctgaagttaatactgcacgttcgatatgcggcgcaagccgggcgcatagcgccaagctgtcatgattaaaggtggataggatgactctgtcctctacattgaatcgcttcactgcctccagcactttttcttccattccctcatagcggatcacgctgttttttaattcaatgttgatgagaaaatccttttttaccgtccacgagagtacatcttctagcagcggcacttttatatcgctgtacgcttgatcgtgaccagcggccgcattcgcagtctttacctcatcataggttgtatccttcacgaatcctttaagtgatgtcgtgcgattaagtctttcatcatgaatcacaacaatgcgtccgtctttcgtcagctgtacatcaagctctatcccatccgctccggcttcaattcctttttcaaatgcaagcattgtattttcgggaaattgacctgatgcccccggtgggcaaaaatctttgtcatcgtttcacctcaaaccctaaagttttctccattatacttattttgtcggctccactctaggattaaggctgtatcaatctactgatcataataagaatcaatgccgttgacaatcgcatctgcggccttttgctggtattcttcacttcccagcttgtccgcgtcagagctgttagtgataaacccaagctccgctaacacacttggcatttgtgaatatgtaatgacgtaaaagtctgattctttcacgcccctgtctctcgtttgtaaggaagaaacgagctgtgactgaatatcggatgccagacgccggctgttctccccttcataatcagattgaaaatacgtttctgttcctgaagctgaagcaaccccggaattcacatgtatgctgacaaaaaggtcagcctgattggcacttgccttagccactctttcctccaaggtcagaaaatgatcgtcagaccgggatgcaacaggattggctccctcctcttttagtttgtccgtcacatgctctgagacagccaaattaatatccttttcaaagagcccgtttccgaccgctccactgtcttcaccgccgtgtccggcatcaatatacactgttttcccttctatcggctctgctgcctgtgcacaaggcgcgagcgtcaaagccaatccgcacagcgccaagctcctccataacattctcaacttactccctccggtctttttatgacgagttctttcgcagctgaatatcttccagctgtaaagttccattatccttctttgtatatttcaccaggacatgtgtctgatctggcagtgattcacattcattacgtttatccttcggaacttgtatcatggtttcttctccattaagagaaaccgcaatcgtatgaggatcagccgagccaatgtattttccctcttcggtaaaccttggcactgagtcatccgcacttgcaacactgcaccccgaaagaaagagcgcagtaaacagcaaaagaaccgtttgtttcacatgaccacctcttcctgatgtttggcttttatctttgaccagaatggcgaatttgtaaagacaacgcgaatgcaggcgagcaagttccatgattttcaaaagggctatacgacccgatcatttcctgttgttagaaagataacgagcagatttgtctatgaggatggctctaattgaggcgccaattagaaaaaattagcggaaagaagcaactttttattcattttaaaaatttgagaatagggtgagcaaatcgtttgacgggtgggtcagccaggcgtaaccttttaaaggatatttactttattgaaagaagttaaagccatgaaaaaattcgttctgctgctggcggcagctgtcatcacatgctccatcggccaccaaatgagcggcggctacaaaggccccgaaaaagagcggcgaaaacatcactctgtactcaagatattcagtcagtaaagcagatcaattgcattaatttttacatataggctagaatatgtgcgaatccaaacgaaagaagatgatcaaatgaatcctaagtataagccactgtttgaaccatttacgtttaaaagcggcgttacaatcgacaaccggatcgcagtagcaccaatgactcattacgcttctaatgaagacggtacaatatctgaagcggagctcgactacatcatcccccgttcaaaagagatgggaatggtgattacagcctgcgcaaatgttacaccggacggaaaagcattccccgggcagccggccatccatgacgattccaacattccaggtttaaaaaagttagcacaagccattcaggcacaaggcgctaaagccgttgttcaaattcatcacggcggtattgagtgcccgtctgagctcgttcctcaacaggatgttgtggggccaagtgacgtgtttgataacggcaaacaaattgctcgcgcattaaaagaagaagaagtggaaaacattgtgaaggcgtttggagaagcgacaagacgcgccattgaagccggctttgacggtgtcgaaattcacggtgcaaacggctacttaattcagcagttttattctccgaaaaccaatcagcgcacggatcgctggggaggaagcgatgaaaaacgattagccttcccgctcgctattgtcgatgaagtgaaaaaagccgcttcagaacatgcgaagggtgcgttcttagtcggctaccgtctgtctccggaagaacctgagacaccgggattgacaatgactgaaacttatacgcttgttgatgctttaggggataaagaattggattatcttcatatctcactgatggacgtgaactcaaaagcgcgccgcggtgcagatccgactcgcacacgcatggacttattgaatgaacgtgtcggaaacaaagtgccgctgatcgccgtcggttccatccattccgctgataacgcgcttgccgtcatcgaaaacggtattccgctagtcgctatgggacgcgaaattctagttgaccctgactggacggtaaaagtaaaagaaggccgtgaaaagcaaatcgaaacagtgatcaaaggcacagataaagaaaaatatcatttgcctgaaccgctatggcaagcaattgtgaacacgccaggctgggtgccttataaagattaatgtgcaaagactgccgaaacgattcggcagtcttttttccctttatataaatagtttgtgtacacatctaaacagcaaaagaaagagctccccacctacttcgaaaagaaaatctaggaaaaatccgtcatgctttcttgcttttttctttttcattcgtacgtctcctttttacatgaatacgccttacttacgattttgcaggagataggtttcattttataacggaaacatctagaatcgatcatgcttcgtgatcctataagatgtatgaatggaccaagagtgcaggtaataccgccattagctttccttacttttcaaacctatcctttactattcgcggatacttaatattcttctcccatactaacaaatgtccccaaaacaaaacgcctcctatttatcagcgcaaactaataaataaaagacgtttgatttaatgaccacttaataagctcatgtttaagaagccttatgttctaatctcagcttatccgcaaccattgcaatgaattccgaatttgtcggtttagcttttgtcatgctgacagtatagccgaacagcgaggaaatggaatcaatgtttcctctgctccatgccacttcaattgcatggcggatcgctctttctacacggcttgcggttgtgttgaattttttggcgatgtccggatagaggacttttgtaatgctgccgagcaattcgatgtcattgtataccattgagattgcttcgcgcagatagagatagcctttaatatgggctgggacgccgatttcatggataatgcttgtgatgctcgcgtcgagatttttcttctttggttcaggctggctgctgcgtataatactgctttgcgatgatggcgcacgatgcgtcacactgctggcatttccgctgacctggcggatatggccgacaaggttttccatatcaaacggtttgagaataaagtaggacgcgcctaaatcgacggcctttttcgtgacatcttcctgtccaaaggctgtcagcataatgacattcggctgttttttcagatctgattccctcagcctctctaaaaccgcaagtccgtctaaatgcggcataataatatctaatacgagcacatcgggatctttttctttaaacagcgacaggcattcctgtccgttataagcaacgccgatcacttccatgtcttcctgtccttctatatattcacttaacaggcttaccagctctcgattatcatcagcaacacaaactttaattttctccacgtttcttcctccccaaatgtagttaacaggattcacccttgctacatgtttacattcgacaaaaccgctatataccctctaaaaaaatcataatcaccaatattagtggcatatctttgttattctatgtttttctctgtttttcgactaaaaatgaaatttgacaaacaaggaaacgtgaatttgtcgaaaaatcttcttttgtatattttaccgtatgtattctgagaagtgaagagggatcaaaataaaaaaactgccggaaactccggcagtcagcttgctttttcttttccgtaaatatcgattcctgcttctgacagcatccattcaatatgaacaccgtagccgcttgtcgggtcatttacaaatacatgggtgacagcaccgatcacttttccgttttgaataatcgggcttccgctcatcccctgtacgatgcctcctgtttctttcaacagccttggatcggtaattttcaacaccattccttttgtcgcagggaatttttgcggcgttgtgctgacgatttcaatatcgaatttttctactttgtcatcatcaataacggttaaaatttcagccggcccttttttgacttcggtagaaaacgcaaccggcaatgcttgatctgatatgttgttttgaatcggctgatgcagcgtgccaaaaattccaaatgggctgtttctgttaatatccccgatcgttttgcgttctgaggaaaatcgcgccagtttttctcccggattaccgcctgtccctttttcaattgatgttacagtggatttaacaatttctccattctccactacaattggtttctttgtgtccatatcggaaatcacgtggccaagtgctccgtatttttttgttttcggttcataaaaggtcatagtgccgatgccggcagcagaatctctgatatataacccgattctgtatttgccttctccttcatccttttctgggatcagcttcgttttgattttctgtttgtcacgtttgatcagtaagtctaaagattcaccagttttcccagccttttgaataaatggggctacatcattcattttttcaattttctgtccattcatctcaataatgatgtcgcccgcttcaattccggccgtttctcccggagattttttgccttcacttgtattgatttgatgaaatccgacgacaagaacaccgacggaatgaagttttacaccgattgattgtccgccaggtataacctttaaatcaggaagaacatgcacttttgtttttttaattggaaatccggcaagatcatatactaattctgactcacctgattttttgcccgtcaccttgatttcatgcggatctttctttactgtaaacgcttctgaggattctgatgtctgagcgtttaccgataaactcgtttcaatcgcgtgtgtttgggtttcaaatactctcatttgcgttggaatcagtaaatattcttttagcggtttgcataaacctacacttaataacgaaacaaggagaattaaacctactgcttttctaatgttatcgggcattcactacttcactctcctcgctcctatcccacaccttctttatgacttgctgctacatcatttaattttgccttctgacggcttatttataactgtcatatgaagaaaaacattggatatactgatgaacgaatggatgtgcacgaaaaaaataagctgcgcttctcgcgcagcttacccagttgttttgacttgatccgcttgttttaaaagttctttcgcatggcgtttcgttaagtcggttacttcgacacctgcaatcatgcgcccgatttccgctaccttttcctgcttagacagcggcttgacacgtgtcgtcgttctgccgtcttttaactccttcgcaatataaagatgcgtatcggccatggcagccacctgaggcaggtgtgtaatgcacagcacttgtgatcctattgacaccttatggatcttctcagcaattgcctgtgcgaccctgccgcttacaccggtatcaacctcatcaaaaatgatcgatgtcacatcctgttgtgaggaaaaaatgctttttatggcaagcatcacccgtgacagctctccacctgaagcgactttcgaaagggatttcagcggctcgcctgtattggttgaaattaaaaacttcaccaggtcaatcccttgttcagtcagctgaacgggctggccgtttacaagcggcgcctcttcattgcgtgacgctgttctgaccttaaattccgtatcaaaagttgatttttccatgtacaggctttttaattcccgatgaatctcatcagccagctttttcgcccatgtttttcggatttgtgacacatttgccgcttccactgcgacatctttgccgacggagtcaagctcctttttcaagctttgaaggtggctgtccctgttttcaatttggtcaatctcttcttcaattttagaagcatattccaaaatgtcttcaacagtggcaccgtattttcgtttcagctgtttgatttcattaagtcgcgtctcaatatagttcaggcgttccggatcaaattcaagctcatccagcatatttctcatctgaaatgtggcatcctcaagcaaatagtaggagttcgaaacactttcagacatttttttcagcggttcgtttatatcagatatatcttcaagctgcgatgatgccattccaacccagtccaatccgccctgctcactgcgaagcgcgttatatgcattttgcagcgattcatatatcttctcaaagtttgaaatttgctggcgctcttcttggagctgttcatcttcgttaagctcaagctttgccgattcgatttcttcgagctgaaattgaataagatcaaggcgatgggccatttcctgttcgctttcagaaagctgcttaagctttttgagcagcttcatataccgctggtacccttcctgatacgttttgagcgcgctttccacttcggccccggcaaacttgtccaaaagctggagatgattttcgtcttccattaacagctggttatcgtgctgcccgtgaatatctaataaaagcctgccgatctctcttagcgaagcaatcgtgacaagcttgccattgacacggcaaacgcttttcccgctcgtgctgatatcccttctcatgacgatcatttcgtctgaaacgtcgattccctgctcagcgcatacgcctaaaacaggatggccgctctccaacagaaacagcccttcaagttcggcttttgcttccccatatctaacaaattcagatgatccgcggcctccgactaaaagagaaatggcatctatgatgatggatttgccggctccggtttctcctgttaaaaccgtaagcccgcgttcaaaagaaaccgtcagttcctcaataatggcaaagtttttaatcgatagttcagctaacaaacagcattacacctcttatctttgttagattttctgttacagcagttcaaggagcctgttttttacgccttctgtatcttcaggagtccggcaaataattaaaatcgtatcatccccgcaaatggtccccatcatttcatcccagtccaaattgtccatcagcgccccgattgcctgggcattgcccggcatcgttttcagcacaatcatatggcttgctgagtctattttcacaaatgcgtccatcaatgcccgctttagcttagacagcggattgaaacgctggtccgccggaagactgtatttgtaagaaccattgtttgtaggcacttttacaaggtgaagttctttaatatcccgtgataccgtggcttgcgttactttgtatccatcctgctttagcatgtcgaccaattcatcctgcgtttcgatttcattgcttgtaatgatctctctgattttaatatgcctctggcctttgttcatgtaagcacctctatttccaagcttatctgttcttttatgttatatgattctctgcacattgtacatgaatgcagaaaaaaggaataatagcgccctattattccggtacatctgcttttttttcttttaacgtcttatgtgcttcttctacaacacgcatgatctcttcttccggcagctcctggccttcctgtccctctcccggccaatgcaaatgaaggagaaactcaatatttccgtctcctcccgtgattggagaaaatgacaagcctttacagatatagccttcagcggcagaaaaactgatcattcgcttgagcacatcagcatgcactttaggatctctgacaatcccttttttgccgacggattcccgtcccgcttcaaactgaggcttaactagagccatgcagtcgctgcccggtacgagcaaagtccttaggacaggcaggatgagccgcagtgaaataaaggacacatcaattgtggcaaactccggcatgccctttgtaaagtctgccggtgttgcataacgaaagttcgtccgttccatcacgacgacccgttcatcctgtctaagcttccacgcaagctgattatagcctacatccacagcgtatgactgtttagctccattttgcaaagcgcagtccgtaaaaccgccggtggaggagccaatatcaatcataattttatctttgacagagacgggaaactctttcaacgctttttcgagctttaagccgcccctgctcacatacctcagcgggtttcctttgacggttaacggaaggtcgcggtcaattttttctccaggcttgtccaagcggttttcgtttgagtagacgatccccgccataatggctcttttggctttttcacgcgtttccgccagccctctttccactaataatacatctaatcgttctttctttgacgtcatgatccaattcctttgtgtgtctttggcggcatcagtaatctaatacgatttgccacctgctgttttgtcagtccaatttcctcaagaagcgccgttacgcttccgtgttcaataaaccgatcaggtatacccattctgtcgatcggagtatgatattcaccttgatcatgagcgaattctaaaatcgagcttccgaaaccgccttctaagaccgcttcttcaattgttaaaattggcaagccttcttttaggatactcttcatcatcttttcatcaatcggcttaataaaacgcgcattcacaacgcgcacggaaaggccttctttctgcagctcttcggctgcttcaatcgccatttcgattgttgtgccgaatgttaagatgacagcatcgttccccggacgcagcacctcccacgtaccgatcggaatcgttttcaactgttcatccatttttacgccgagtccgtttcctcgcggaaaacgcatcgctatcgggccttcgtcatagctaagtgctgtatgaaccatgtgctggccttcattttcgtctttcggcatcattaagaccatgtttggaatgtggcgcataaacgcaatatcaaacacgccttgatgtgtctctccatcagcgccaacgagtcctgcacggtcaattccaataaacacattggcgttttggcggcagatgtcatggacaacttggtcatatgccctttgcaggaaggttgagtaaatcgccaaaaacggcttcatcccctgcatcgccatagctgccgccatcgttgcggcatgctgttctgcgattcctacgtcgaacatccggtcagggaattcctttgcgaagccttcaagctttgaaccgacaggcatagccggcgtaatggctacaatgcgtccgtcctcgcgcgccattcgctgcacagttccgctgacaagaccgctccacgaaggagctgcggctttcggctttacaaagtcaccggtattaattttatatggtccggtaccatgccatgtcccaatcgtatcggtctcagccggtttgtaccccttcccttttttcgtgatgacgtgcagaagaacagggcctttcgtttttttggcgtattgaagattctcaatcagctcatgataagaatgtccgtccaccgggcccaaatacgtaaaaccgagctcctcgaaaaacattccggagacgagcatgtatttcaggctgtctttgacccgttccgccgtggcggcaagcttgcccccaactgccggaatctttttaaataagtattcaagctcatctttcacccactggtatttccccgcagtacggagccgtccgagcatagagtgaatggcaccgacatttggcgcaatactcatttcattatcattaaggatgacaatcatgtcttttttctcgtcgccgatgtggttaagggcttcgagcgccataccgccggtcagcgcgccgtcaccaatgatcggaataatatattcatccgttcctttaatatcacgggcagctgccattcccatcgcgcctgacagagaagtcgagctgtgcccggtttcccaaacatcgtgctcgctttcacttcgctttggaaatccgcaaagccctttgtactggcgaagcgtcgcaaattcttttccgcgtcctgtcagcagcttatggacatacgactgatggcctacatcccataaaaatttgtctttcgggctgttaaattccttatgcagggcaacagtaagctctacgacacctaagtttgggccgatgtggccgccggaagcggataaactggtaattaaaaactgacggatttcatcacttaatttctctaattcatcaatggacatgttttttaaaaacgacgggtcctgtattgataaaagatccaaagcggatcaactcactttcagcatgaatttctgcaatgatacatgtcttttgcatgccgagctgacaataatctcagacataaaaaaagacaaacgcgcttttccttttcatttttcatataaactgcttacattttaccatatctcgtgcagccgcttcaaattaggatcgttttagtgatctcttgccgcaattaaatcacaaagctcatataaaaggtctttttgaagagagagtccgccgatcaatcgcttcgcctcttttatatgaacatccaatttatgtttggccccttccaatgaaagaagtgacgggtatgtcgatttgtcatttgtggtatccgagccgacacgtttgccgattttctcttcactgccttctaaatctaaaatatcgtctctgatttgaaatccgattccaatgtggctgctgaaggtacgcagtgtttcaatgtcttcctcaggcgcatcagccaaaatagcacctgcgattacacaaaagccaagaagcttggcagttttccgttcatgaatggattcgagctcttcaagcgtgacttgtcggttttccgcttccatatcagctacttgccccccgaccatgccttcggtgcctgccgctgaaatcagttcatccacaagccgcaggcgcttttctgctgacacctcgtctgacacgtgggaggtaatcagcttaaagctttctgtgagcagcccgtcacccgctaatactgccgtcgcttcaccaaacactttatggtttgtcggcttcccgcggcgcaaatcgtcatcatccatgcatggaagatcatcatgaattaacgaatacgtgtgaatcatttcgacagcacagcccaccggaatgccgtctttttcgctttttccatatgcgtttaaaacagccagtacaatcagaggccgcagccgctttccgccggcctctagagaatacagcatagatttctttaatgagtccggcatatcaagcttttcagtatagacagaaagctgattttcaattgtttttttccggtccgccagaaagctcgttaatttatttgtcaccttcgtcttcctcctgaacactgaaaggtgccagttcgccgtcttcttttaaaatgaagtccatttgcttttcgactttttgcagcttttcatggcacatttttgacagagccatgccttcttggaaatagttaatggcttgctctagaggcacatctccctcttcaagctttgatacaatgctctcaagccctttcatcgcttcttcaaatgtcatgttttcattttttttcacgtctgtcatttttcttccctctcttttctaatacttcacaggtcagcacgccatccttcagcttgacttcaagccggtcctgctcttctatctgactgacacttttaatgagtttatcttctttataagccaagctgtatcctctttccatcacttgaagaggacttagtgcattcagcttgccaagaacggtttgaaattgggaatgcagctgcttcatttggatattcatattttttctcagctgatttgtttgttcctggtatcgtgttctcgcttgtttcagctgttcatgaggatgcagtgcctctaatctgtacgtttcacgctccagctgtctgcttttccgatctaaaagagcggtcagctgtgcttgaaactgctggtacgcgaggtcaaactgctgctctttttgcgcatacaaacgctttggaaaacgaaaggcataggacgattgcagcgtttgaattcgttcttttttctggccgagatgctgctgcatcgctcttgtcattctgacttccactgtttttgtccgttcgattaaatcagtggtatgaggcacagcaatctcagctgctcctgtcggcgtcgcggctctgatatcggcgacaaaatcactgatcgtaaaatccgtctcatgtccgactgccgatataatcggaatattggaagcaaagatggcgcgcgctacaatttcttcattgaatgcccacagttcttctatcgaaccgccgcctctcccgacaattaatacgtcgcaaatctctttttcatttgcctcttcaatgcgcgtaacgatggatctgctcgcattttcaccttgtacgagcgctggaagaacaatgacttttacaaggggatatcttctttttagagttgtaataacgtctctgacagcggcacccgttggagatgtcacaacaccgattgtggctggaaatgcggggatttgttttttgtagcggtcgtcaaataaaccttctccggcaagcttcttttttaattcttcgtacgctaaataaagcgctccaaccccgtcaggctgcatttctttggcatataattgatagtttccgctcggttcatatacggaaattccgcctcttaccagcactttcattccgttttcaggtttaaaaggcagacgctcgctttgtctcgcgaacatcaccgactgcattcttgcgttttcgtcttttaaagtgaaataaatatgccctcgtgtgtgtatctttacattcgacaattcgcctttaatccaaatattttcaaggtgaggatctacatcgaattttcgttttatatactttgtcagcgctgagacggtcacatacgctgcttcacccatgtctaaaaactcctctcctaagcattcctgcaccataactaaagaaaacccgccctggctttaggagcctgaagaagcgggtatcgtgctcatattcaaggcgggtaaacatttcgcctgtgaatatctccaattatctatgataacgtacgtttcgcagatttaacagtattatgcgcaagcatcgtgatggtcatcggacctactccgcccggaaccggcgtgatgaaggacgctttttcctttgccccttcaaattcaacgtctccgcaaagctttccgttttccagacggttaacgccgacgtcaatgacaacagcgccctctttgatctggtctgcactgatgaagttggctctgccgactgccaccaccaggatgtccgcttttttcgtatgttcagtaatattttctgttcttgaatgacagtaagtaaccgtcgcgttttcatttaataaaagctggccgacaggtttgccgacaatgttgcttcggccgactacaacaacctctttaccggaaaggtcaatattggttttcttcaaaagctcaacaattccatgaggcgtgcaaggaagaaacgtatcttcgccaagcagcattttccctacgtttaacggatgaaaaccgtctacatctttatcaggggagatacgttcgatcaccgctttttcagaaatatggtctgggagcggaagctgaacgagaatgccatgaaactcagggtcttggttatattgatcaataatggaaagcagttcagcttctgtgaggctgctgtcaaattgatcgagcttgaaattcattcccattgtttctgccgcttttttctttcctcgcacgtaagagtgagaagcaggatcatctccaatcaaaataaccgccagtccgggagtgacgccttgctttttaagctcttctacctcttttgccaattgttcgcgtttttctctagccgtttcttttccgtcgatgattgttgcagtcattttctttcctcctatgattgttcaatatcagatttaatgttagaaagaaccccgtttacaaactttgtcgctttgtcatcaccaaaccgttttgccagctcaatcgcttcgttcatggagacattaaccggaatgtcttcggcatatgccatttcatatgctgccaggcgcaaaatcgcacggtcaacattggcaatccgatcgagcttccaattcaccagatgcttggagatcatttcatccagctggttttggtgttccaataccccgtgtacaagctgttcaaagaaaggatctgttttttcttcatccagtgcgtgttctatggcttcattcactgcaatatcgctgacatcaatttgaaatagtgcctgcaaagctttttctcttgctgttcttcttttcattttctttctcctttgatcctctttatccgcttgtcgttaagccacaaagagatcataacatatttttttcgtatccgcatattgaaatcaaggtttttttaccctattgccgaatattttcacacaccttaatatgattattcggatttcacgttcatgaagaaactcggctatgtaagccggctttcttcatgctttgaaataaagggtaacgtgtaaaaaaaccaaagggccgccctccccttggtttcgtgttaagccatttacatttcttcgtcgatttggacttcttgggcttttgtgtcaaattgaatgccgacgatgtgaatattgatctcgttaatcgaaagagacgtcatatttaataaggtttgacgaatgttttcctgaacggatgctgcaactttcggaatcgaaacgccaaatgtaacgacacagtatacatcgatcgtaattctgtcatccgccaggtcgactttgacacctttgccatgattcactttgccaaagcgctcaacgacgcctgtcgcaaagtttccgcgcatttcggcaactccatcaacttctgatgctgcaatgccggcaatgacctcaatgacctccggtgcaatctcaaccttacccaaatgcgtatcttcgtgatccattttaagcaagctgttgtctttcattcaattcacctccgtaaaaattatgagcccattacatcatatgtttctaaaaatttcgtattaaactctccgctcacaaatgtttcgtgttcaagcagttttaaatggaaagggattgttgtctcaatgccttcgatgacgaattcgctcaatgcgcgcttcatgcgagcaatcgcttcatccctcgtttttccgtatgtgattacctttgcaatcatgctgtcatagtacggtgggatggaatagccagggtacgcagctgaatcgacacggacaccaagaccgccaggaggcaggtacattttaatttcgccaggtgacggcatgaaatttttacttgggttttctgcgttgattcggcattcgatggcccagccttcaaattcaacatcttcttgcttgaggctcagttccattcctgatgctactttgatttgttccttgatcaggtcagtgcccgtcaccatttctgtgactgggtgctctacctgaattctcgtgttcatttccatgaagtaatagcgctgttcattgtagtcatagataaattcaactgttccagcacctgtatagccaaccgcttttgcagcctttaccgctgcatctcccatttgctccctgatttctgaatcaagggcaggagatggtgattcttccaaaagcttttgcaggcgtctttggatcgagcagtcgcgttcgcccaaatggatcgtatttccgtagttatcagcaagcacttggatctcaacgtggcgaaaatcttctatgtatttttcgatgtatacacctggattcccaaatgcagttgccgcttcctgctgtgtaatcttaatgccattaatcagttcctcttcagtacgggcaaccctaattccttttccgcctccgcctgcggtggcttttataattacaggatacccaatttcattagcaagcgaaaccgcttcttccacattttctataattccctgtgaacccggtacgattggcacgccggcctgtttcatcgtttcccgcgcaacgtcttttgttcccatttttgaaatggcgtcagcgctcgggccgacaaacgtgacattaacttcttcacataattcagcgaaatcagcattttcagctaaaaatccgtatcccggatgaatggcgtccgtgccagtcagctttgcaacactcacaatatttgtaacgtttaaatagctgtcttttgatgctttcggtccgatacaaaaagcttcatcggccatttgaacatgaagggcatctttatcagcttctgaataaacagcgacagtctcaattccgagctctctgcaggctctgatgattctgacagcaatttctcctctgttggcgatcaatagctttttaatcatgttaagtctccttactccgcttttacaagaaatagaggttgtccgtattcgaccagctggccgttttctactaatacttcaacgatttcgcctttcacttctgcttcgatttcgttgaaaagcttcatcgcttctacaatgcagacaactgtgttttcatttacttttgaaccggctgttacatacgggccagcttccggtgatgaagaagcataaaatgttcctaccattggtgaagtgattttatgcagattctcatcttgctttggtgcttcttgggcaggtgccgctgcttgctgcgcttgcggctggactgcctgcggagcctgtgcttgtacaggtgctgccggtgcctgctgcatgacttgaaccgtgcctgcttcgtgttttttcagttttaaggatacaccttcattttcatatacgaattcgtcaattgtagactcgtcaattgctttaatcagctcgtggatttctttgatatttaacattcaatcgcactcctatgtatgaaatttctttttttataggttactactaaaagtacatactatgttcatcttacaggagcggacttttgaattcaactctaatatgacagcaacgcaaaaagcccgcttgtttagcgggcttctttttcctctttcttacttggatggttcaaacgtgacagcgacatctttcattgttttgatttcttttgcgacaaggtctataatggctgtcgccttcgatttggagtgtttgtctgatttgactgtaatattgattttatctccttcagcattaacgagcgcatcctcgtaaccttgtgttttaatcagcgtttctagctgtttttctgttccttccacttcactgagagccgtcattttatcgtatgcttcgcttttctccttggctgttgcatcatcgcttgacacaatggcattcagctcttctctttctttgcttctggcatcttctaaatcaagacggtacgttgtaaacaaatcatcatcggctgtttccgtaacaacagttcctttttcactggcttcagcggatgtttccttgtctgctgatgaatctttcgttccctttgttccatcttcttttcctttttcagtttctgtaccgcttttttccttcgtgtcttccttggcaggcgctttttcagttgcgacctctccgctgtcagacgcgcttttttcactttgcatctgcacggcgtttttgctttccggcgacatgatatagtagacgcttaacaccacgacaagactgagcattgttaatagccaaacggtttgttttttaagcatttatgaatcctcctttatttttttaggggcaaccgcaacccggtggcttggaacatccaggacccgtgtcaccgcttcgataatggtttgttttatttgaacgttgtccactccttgagcaacaacgagtacaccgcgtatatcaggttttttcgtttggacgacgacaggtgtttctttatcgccgtttttgatcatgacgatttcttcctccgatgattggtctgtaacgcttcttttcccgccttctttgtcagtttcttcagtggttgtatttttgtttgatttgtttttttcgtatactttcagcgacgttgcatctacattcacgacaaccgagacatcgtccacaccaatgattgtttcaagaatttctttcagctgattttcgtattctttttcatagtcatcgatcgagtctttaggtttatcagattttgaggctttaaacacttcggctgttttctctttgctgtctgcggaatgttgtgatgatacggccgttatcgttttggcgttttcagttttctcaggtgaagaaaacagctggctgacaagcataaaggaaactccgagaacaaaaacgaatagaaagtaatgatatttggtcagcttcggcttttcgccgtccttcgtttgtcccggaagaaactgctttttcaatacattccataatccgtttttattcattgccgacactctccccgccttccatatgaacagtaattttctcacttccgatttcccaaatgtccgcgagctgcgtttgtatctgtttggcttctttttgttcggctgcttcttttgttacgtatgcatgatctgtatcaatgtggaccggcgcgaccgtttggaccgttttttcagaagacggggccatatacacgctgattgttttaatatcctcttctgaatctaccttttctcctgccgtgagtttgatgcggcctactttatattcatcatgactgaatctctcctccgctttcttttttagttggacagccatttcttctagaatatatgcgcgctgggaagcttgtatttctattttttttgaattgatttgattttttatgtcggcagactctgactgcccgttttttgtgaggtattcaaagatgacttcgggatctgtcttgaaaagtttaaaaatcggcgtaagcatgacgacaatcaagagcaggctgactaccatttttgcgtacttttgcatgctggagctcggcagcagcatatcaatcacaattgcaaataggataaacaacacgatggtggtaagccattccgttaaaaaactcattcgcctgcctccttcatttcatcatcatcgtgaggtttccggctgtgattatgacagtaaggcttaaaaaaaacatgagagacacaatggcgagagttgcaaaaatataaatgacgcttttgctgatgacgtcgaggcaggtgatgacgggcccgcctcctagcggctgaagaatcgcggctgccagcttataaataaaagcgagggaaagcactttgattgccggaaatgccgcgatacagatcaaaatagcaacaccgagaatccctaccgtatttttcagcagtaaagaggcgctgattactgtatctgttgcgtctgtaaacattcggccaagcacaggaataaaatttccggttataaatttagccgtcctgagcgtaatgccgtctgtcactgcagccgaggctccctgaacagagatgacgccgagaaagatggtaagaaaaacagccagcgctccgatggcgatatttctgagcaggttggccagctgtgttactttgtattgttcggtcatggtgctgacaatgctcagaatcgctgataagaaaatcagcggcatgacgatattctgaatcaagagaccgctcgtgttcatcaggaagaggataacaggatgaaagaaggcagcagatacagctccgcctgaggaagccaaaagcgccaagaggagcggaatgagcgccaggataaagctggtcatcgtctgaatcgcctcagttgcatagttaattgccacatgaaagctattaagcgcaaggataatcagcaccatgtacacaattgagtaagcgaccttactgacggtgctttgctgaaaagcattttgcaaaagctgcagaatgacgcaaaaaatcgtgagcaaaatcaatgtgcccagcagctttccgttggcaagcacttcatgaaacaaataagaaaagagagctttcagccattcttgaggtgagaatgatttatcgccattgataaactccattaagctgcctttttggctttccggcagcagtccgccgtattctgtcataatgtcattccaaaattccccgatcttatctgtttcaagcgaggctgctgtcctttccgctaattgctcagctgtttcagcatggtcttccgttttttctgcattaccagctgcttgtacaatttctgcacggcctgctatgatcagcacggccaaaagcaaaacccattgaaagcgcttcaatctaccgcctcctttcggttatgacatagaaggtataagtccgagaatcgtctcgataatgacggttaaaataggcacagccataacgagtattaaaattttccccgccaattctattttcgaggcgatggctccttgaccggcatcttttgtgagctgtgccccgaattcagcaatataggcgattccgataatctttaaaatggtttcaacatagaccatgttgacatttgcattaatcgcaattttttctatcattcgaataatgtcgtagatttggtctactaaataaagaaaaatggcacatccggcaaaaacgacgattaaaaacgcaaaagtcggcttttgttcttttacgattaaagaaaggaaggtggcgatcagccctaaacctacaatttgaacaatgtcaatctgcaagccccctatccttggaataaaaacacagcttttatctttttaaataggtcatctacaatcgtggcgaccataaataaaatatagataaaacctaacagcgtcacccactgagcgtattctttcttgcccatctgatccaatatcgtgtgtaaaaaagcgaccacgattcccactccggcgatttgaaatatgacattcacgtctactcccattttatttttgctcccctcacgtttacatcaatagaagaatgagtaacaagcccgctaaaaagcccaaactttttatcatcttttcatttttcgcttgcgcctgctcagcatccgcttccgaggcttccaaatgtgtcagcgccagcttgatgtgcttttgctgagagattcgatcatgaatcccaagcgtctcgccaaactgcttcagcacttcgtattcgctttttttcaaagacagggtgtcccatacattctttaagctttgctcccacgccgttttcgcggaatcacttcccttgtccagctgatcactgaatgcggaaaaaagagctgaaacaggctgtgcgagctgtttggcaatctgctgtgaagcagtatgaagcggtgtatggccgtacatgatttcagcctcgagggattgaagcgccgcacgcagctggcggatttgccgcggccgttctgtataaatcttcgccatctcaaaacctgtccatgttgtcgctaccacaatgaatacagcgcccagcagcttcagcatgttttcacgcccgtcgtcctagacagcacatttccgtctttgtcataaatttggctcactgtgcccggccccttcgctctcgataattccaaatagcggtcaaaggctctttcttcccacaaacgcttcaatgaaggccgcttcatcaggtcggatatgctccagccatgcgccgatacgattactgaaacaccggcatgcagcgcctccagaagtgcatctgtatcttccatacgcccgatttcatcgacaatcatcacctcagggctcatggatcgaatcatcatcatcagcccttcagcttttggacaggcatctaacacgtcaattctctgaccaaattgatgctgcggaatgccgcgaagacatccggcaatttctgaccgttcatcgacgattcctgtctttacgggcagcatggtttttttgccggtgcttgagagcctcgctaggtcccggagaagtgttgttttgcctgtttggggcggtccgataatcagcgtattcagccagctgttttgatataagtatggaagcagcggctccgcaatccccagcttttgccgggcaattcgtatattaaaagatgcgatgtcacggaggcctttcacacctccgttttccgtaatgactctgcccgccagtccgactctgtggccgcctctgatcgtgacataccctttcttcagctcttcttcaagtgtatacatactatagttgctgagccggctcaggatcagatgggcatcctcggccgtgcccgcataggacaaataaacaggttgtcctcttcgaatcaattcaacagggcggttgatccgaattctgacttcttcgatttccagccattgttgttccggtatttcagaaagggcgtttttcatggattcagggagaacctcagcgatttcattcaacagagcctcctcctttctaccgattggcttctttaaaatgtatgatgtgaggcagactttatgacaagcctctctttatttatgaacacccgccaaaatcaagacaacacccgtaaaaatcagaatcagctttgcatacgaaagctgcccggcaatttggtagattccgacagtcatcgtaatgataaaaatcaacggaccgacaatagcgagaatgctgttaaccacaaccgccttccggacatcgttggtcacaagcatgacaattgctgccgtcagctcaatcatagaggataaaactcgtaatcccgccattgttaaaacagtagaattgatatttccaagtaaaaatttcatagcactctcccaacctcccatttttttatatgatatgctctagcttgctgaagtagtcttgtcattttcgtataaaagaaagattctgtttttgggcacaaaaaaaagcctgcccccatttgggaacagacttctttttttctttctatgctcttgaaacgtaagaaccgtctgatgtattgacaacaagtgtgtcgccttcattcacaaagaacggcacgtttacaacaagcccggtttcagttttcgcaggttttgtaccgcctgacgctgtatcacctttaataccaggttcagtttcaacaactttcagctcaactgtgtttggaagttcgataccaagtgtttcatcctggtacatcatgatatgcacagacatgttttctagcaggtattttaattcttcttcgatttgagttgcgctcagttcaagctgctcataagaagaagtatccataaatacgtgctgatctccgtttgcatatagatattgcattgttttggtttcgatttgcgctttcgctactttttcaccagcgcggaatgttttttcctgaatcgcgccagtgcgaaggttgcggagtttagagcggacaaatgccgcaccttttccaggttttacgtgctggaagtcaacgacgcgccaaatgccgccatctacttcaattgttaatcctgtacggaaatcgttaactgaaatcatgtttaatgtcctcctatattccaatcacaaaataataagttcttttggggaatgggtgattgtccggttgccgttttctgtaatcacgatgtcatcttcaatgcggacaccgcctgtttctggtatgtaaatgcccggctccactgtgaccaccatacccggttcaaggatagctgaagatctgacggataatcccggcgattcatgaacttccatgccgagcccgtgcccggttgaatggccgaaatagtcaccgtagccttttgcagcaatatgatcccttgtgagggcgtcagcctcttttcctgtcattcccggcttaatatgtgcgacgccaagcgcctgagcatcaaatacaacctgatagatctccttcaattgatcactgggctgacctacagcgaccgtccgggtaatatcagaacaatatcctttataataagcgccaaaatcaagcgtaacaaggtctccgctttcaatcagtttgtcactggccacaccgtgcggaaggcttgaacgaaggcctgaggcgacaatcatatcaaaagaagagctgtctgctccctggcttctcatataaaactccagctcattggcaacagcgatttcagaaatgccgggtttcataaacgtcaagatatgtctgaaggcatcatctgcaatcttcgcagcttcctctaatatcttaatctcttcactagacttaatcaagcgcaacttttccacggattcagccacaggcactaattctgcatcactgataacggcgctgtatgaagcgtaagtgccatatgtcatgctgttctgttcaaagccgagacgcttgatgccaaacgattcaacagtgttggcagtggtctgaatcaggctgccgccatgttcaatgatctcaaagccctttacctgaaccttcgcctgctcagtataacgaaaatccgtaataaacgctgctttgtcacccgatataacagccaaacccgctgaacctgtaaaccctgtcatatagcgtacattcgtgctgcttgtaatcagcatgccgtcaattcccagctgtccaaacaggtttcttaatttctctagcttcatcttgattctcccccttgctggcttaataagtagcgaacagcaagcttgtagccttcagctccaagaccgacaatctgccctttcgcaacaggagcgataaccgactgatgcctgaattcttccctggcgtataagtttgataaatgcacctctaccacaggaagactgatgcttgaaacagcatccctgatcgcatagctgtaatgactcagggcgccagggttcagaacaatcccgctgtattgctcctcagcctcatgtatcgcatctatcaaatcaccttcgtgattagactggaagaaagtgagctggatatgtaaggcttcagcaaactgaaaaagatctgtttcaatatcggtcagtgtctggcggccgaatacttcaggctcacgactcccaagccggttaacattcggtccgttcaaaatcaaaaaatgaggcacataatctctccttttcgcgagggtttctcatgtaaaaaatgttcacttctcgtgaacattttatcatactggaaaaggattatacactattctctatgcattcccagcgcacgtgcaagcttttccgaattcagctcattgtattcaaatgaaatggaatacccgacaaaaagcccgtaaagcaaataaatgcaaatggtcgtaataattgtatctgatgtcagttcggtcaccgtgcgcacttctggaaaaatcggattaaaaacaaaaaacacgagcagccaaagcaccaagccgtataaaatacccggccacattgtttttaaacgtttcaatagaagaaaataaagaaacgctgcgccaattgaaattactccaatcaaaatgatgctgattaccgttcccagcccatgttttttccactctccgagcacaaacggctgcaatatcatattcgggctgatttcggaaaaatgaaacaaatatgcgatataagcaacgaaactccaaagtacacctccgcaaaaacctgttgccgccaccctgccggccattgaaacaggcggcttttgcttctcattcaattcttcattttgttctgtatctttttcgctagtcatcatggcacctccagttaaagtgtgcccaaaaaataaaatgtcaataaaaaagctcacactttttggaagctgcgagtaaaatttgaaaataacgggtataatgcatgtagaaaaagcaaggctatggcaattttttcagcctgtcaatctagaggtttagcgctgtttcctgtacaatagagtgaaaggaaatggttagcaatcctaaagaaataggcaggttgataatatgtcaaaacataaagttccgcccgcttacggcgggcaggctgttgtggaaggcgttatgtttggcggaaagcatcattacgttacagccatcaaaagaacggatggaagcattgacttttttaagcttccacgcaaacacaacccgaaactgaacatcgtgaaaaagatcccgtttttacgggggatcgcggccattatcgaagcgagtgcaaacggcacaaagcatctgaatttttcaagcgaacgttacgggctcgatccatctgaagacgagacacttgagcaggaagaaaaaaaatcctccgggctgtctatgtatctcagcctcgcagttataggcgtcctatcatttttgttcagtaaattcgtatttacattggttccagttttcttagctgaactgacaaggccgattttttcctcggacacggcgcaaatcgcggttgaaagcctgtttaagttgattttgctgctcggttacatctattttttgtccatgacaccgcttattaaaagagtgtttcaatatcatggagccgaacataaagtcataaactgttatgaacagaatttgccaattactgtggagaacgtccaaaaccaatctcggcttcattaccgctgcggatcaagctttattttatttacgattattgtcggcatgtttgtttatttactcgttccgacagatccgctttggctgcgtgttatagatcgtgtcgcactgataccggtcgtgcttggtatatcctttgaagttctgcagctgacaaacaaagtgcgtgacattcccggtctgaaaatacttgggtacccgggtctttggcttcagctgttaaccacaaaggaacctaaggatgaccaggttgaagttgccatcgaaagctttaacgaacttctcagactcgaagaattgtctgagcaaaatcagaagccttctcacaacgtcatctaaaatccgttgccctgctattactttcggaggtggacagttatgaatcatcgtgtacaacctattattgctgtattaattgcgctgggagcgttcggtttcctctatgtgctggtaaccaatcccggagaaatggcaaaaatggcggtaaccgtcatcgtggcaggtatcattatttattttattgtgaaatatgtaatgaatcgaaatgcgggcagcgaaggagcagccttcaaaaaagcggcgaaacaatcgcggcgccggatgaaagaacaaaaagcaaaacaccgcgccggacataagggacgtgtcagccacctgcgaagcgttccgagcgccagcaagcctaagccgatgattctcaagaaaaaaagccagactcagctgactgttatagaagggaaaaaaataaaaagaaaaacagggcgcttttttaataggtccactgctttaaaaacagctctgtccgtcttttacctagctcaatcagggctagttttttttgttttgttaaatgaaaatcagttgccattacgccatcaaccgggagaaaaatgatattttgttcatagcgtgatgcaatgtgccttgcgtcatgggcatccttcatcgtttcaaacagggcgccgaacagttcaaaagcgttgcggatattttttttcggacgctctctttcacgcggcgcaagcgtcacaccgatcacagggcgctttctttcctttgaaaacagccagatggggaaattgcttaacacacctccgtcgacaaccgtggcggtgcctgtgtccgtttttaattttatcggttcaaaaaaatacggaatgctgcagctcattctgaccgctctggcaaccgggaacatatcgggatttaacccgtaacgggccaaatcgtccggcaaaacaatcatggtgccgtttgtcagatcagaagcaataaggcgcagagaccctttcttcaaatcgccgaaaacccttatgcctttcgctcttaacagatcagcaatccatttttctatcgtatcgcctttgtataagccaagacgccagtagatggacacccactggagcatctttaaggggagaaatgagtacctctgatccagcaatttctctccgtccacttcttcaattaaagcgtggatttccttactggtgtaacctgacgcaatgaaagcggcaataatggcgccggcgcttgtacccgcaacccttttaaagcggaagcctttttcctcaagcacttcataagcgcctgcgagcgcaatgccttttactcctccgccggaaaacacaccgtcaatatacatctcattccctccccctccatccgatcgtttattaccattttaagaaaacacgcgaagaaatagaccaatgaatgacgggcggcgtcagcgtatcaaaaaagacggcctccttcgagaccgcctttttactgattatgatgttctgttttcttttggattgatttcagatcttttttacgggcatcatcttcttcaaaatattgaacaagatccccgatgcgatcaatgctgttccagcttaaatgatgttcgattccttcgacatcgttatatattttctcttcatcaacaccaatgattcttaaaaactgctcaagcaattcatgtctgtataccagccgtttgcctatttttttccctttagacgttaacacgagaccgcgatatttttcataaattaaatattcgtctttatctagtttttgaaccatttttgttacagaggagggatggactgccaatgcttccgcgatatcggaaactcgtgcatatcctttttcttcaatcagcatataaatctgttcaatataatcttccatacttggtgttgtcatcgaaaccctcccaaaaagcaccttaactttataaaccattacaagtttacactaatgaacttgaaaaaacaaggatgctccgcgggtcaaaagccctgtttaccgcttataattccattcatctgaagcgtactttgtttcagccaagtgatgaacaaaatcaagctcttcctgagaaagttcatatggctccaaatgaatgttaagacctgtttcaaatccttctttaaaggctttacgagcctcatccatcgtcacccgcttttcagtgagttcattaatggcaaccgctttatttttgaaattgcgctgcatccgttctcttactctttcactcggatataagaacagatcgaacagcttatcctcatccaaatcaagcagaatggagccatgctgaagaatcacgcctttttgtctcgtttgcgcgcttcccgccaccttgcgcccctcaaccactagctcataccatgaaggcgcgtcaaaacaaacagatgaccgcggattttttaagctttctttttctttttcagttctcgggatggcaaagtaagcgtccagaccgagatttctaaagccttgaagtatgccttctgaaataacccggtaagcctcagtaacagttgccggcatctcggggtgctcttccgaaacaattacgctgtatgtcagttcctgatcgtgcagcacacctctcccgccggtcgggcgtctgacgaatccgagattatatttatgtactgcttcaaaattgatttcctttttaatattttgaaaataccctacagaaagtgtcgccggattccagccgtaaaaacggataaccggggggattttcttttcgctgtgccaatataaaagcgcttcatcaagcgccatattgaatgcaggacttgcattgcctgagtctataaaccgccaagtttctttttgcattttaagaccttccttaccgttttaatagaatcagtttatcaaactgtcgggaaaatgaaaaatattttagttccattatagatgacaatcacgctgtgctttactataatagtatttgtcgaaaacggctctatgaccttgttttatgaagcagggttttgattttatatgctaaaggagtagaatcacattgtctaatatgatcgttttgattatttttgctgcatttatcatctatatgattgcttcatatgtctatcagcagcgaattatgaaaacacttaccgaagaagaattccgcgcgggttaccgcaaagcgcagcttattgatgttcgtgagccaaatgagtttgagggcggacatattttaggcgcccgcaacatcccgctttcccagctgaaacagagaaaaaatgagatccgtacggacaagcctgtttacctgtactgccaaaacagtgtccgcagcggacgcgcggcacaaaccctgcgcaaaaacggctgcactgagatttacaacctaaaaggcggctttaaaaaatggggcggaaagattaaagcgaagaaataaagcaaacagctgtctggtagacagctgtttttatttatctttcttccgcctcgtatctgagcaccgggtgtctcgccgcttttgtttcatccattctttttacaatcgttgtatgcggggcctcctgaacaagctccggattctcctccgcttcttttgcgatttgaatcatagcatcaacaaacgcgtccagtgtttcctttgattcggtctctgtcggctcgatcatgatgcattcttcaacattaagcgggaaataaatcgtcggcggatgatagccgaaatcaaggagccgctttgcaatatcaagcgtacgcacacccagctttttctgccgcttccctgataatacaaattcatgcttgcaatggcggtcaaacggaagatcgtaataaggcgcgagctttctcatcatatagttggcgtttaacactgcgttctcagtaacagcctttaatccgtcaggccccatggagcgaatatacgtatacgctcttacattaatgccaaagttgccgtaatacggcttcacacggccgatcgcatgagggcggtcataatcaaacgtaaagcgcccttcttttttgactaaaactggctttggcaaataaggaatcagatcttgttttacgccgacagggcctgagcccgggcctccgccgccatgagggcctgtgaatgttttatgcaggttgaggtgcaccacgtcaaatcccatatcaccaggtctcgccttgcttaaaacggcatttaaattagcgccgtcataatacagtttccccccgcttggtgtacaatttccgccatctctgtaatctgctcctcaaacaagccgagcgtgttcggattcgtcagcataagagctgcagtttcttcattcactgctctttttaaatcctctaaatcaacaagccctttttcattcgatttcaccgtaactgtttcaaagcctgctactgtcgctgatgcaggattcgtcccatgcgcggaatcagggacaatgaccttcgtccgcttgaaatccccgcgagcttcatgataggcacggatcatcatcagccccgtccattcgccgtgcgctccggcagcaggctgaagcgtaacctcatccattcccgttatttcttcaaggtgcttgcttaaatcatataaaagctctaatgcgccttgcaccgtgtcttcatcctgaagaggatgaatcgcagcaaaaccagatatacgtgcgattttttcattgattttcggattgtatttcatcgtgcaagaaccgagaggataaaaaccggaatccaccccgtgattgcgtttggacagcgctgtataatggcgcatgatgtctagctctgaaacctccggcagcgctgcgtcttcgtcacgaatataggtgtctgacaagaggtcccccaattcgatttccggtacatcgagctccggcagactatagccgattcggccttctcttgaaagttcaaaaataagtgcctggtcctgattactcatggcgatcccccaattcctgaatgagtgcgtcaatttcttcttttgttctcagctccgttacagcaatcagcatatggcagtccagctccggatacgtcaacccaagatcatatccgccaatcatgccttttgccagcaaacgcttgttcacagctctcaccggctcatccagtttgatgacaaattcattaaacatcggcccgtcaaacataacggtaaggcctgctttttttgcttcttgctttgcatagttggcttttaagaggttttggcgggctatatcttttacgccgttttttccgagagcagtcatggccactgatgctgccagcgcatttaaagcttggttcgagcatatatttgatgttgctttatcccggcggatatgctgctccctggcttgcagggtaagcacaaagcctctttttccgttttcgtcttccgtttgtccgacgagacggcccggcacctttctcattaattttttagtaacggcaaaaaagccgcaatgcgggccgccgtatgctgaaggaatgccgaaaggctgcgcatcaccgacgacgatatcagactgaaacttgcccggcggagtgagaagacctagcgccagcgggttggctgaaacaataaacatggatttcccttgatgagcgataggctcaatatcctttagcggctcgatccggccgaaaaaattcgggtactgaacgatcactgcggctgtgttctcgcaaacggtttggcgcaatgcatcaagatccgtaacgccatccgcagcgggtacttcaacaacatcaatatactgaccttttgcgtacgttttcagcacctctcgcgattcaggatgcacggtttttgacacaacaatttttttctttttcgtgtggcctgaagcaagcattgctgcttctgccaaggctgttccgccgtcatacatcgaggagttggcgatatccatgcctgtcagttcacagatcatcgtttggaattcaaaaatagcctggagctctccttgtgaaatctctggctgataaggcgtatatgcggtataaaactcagagcgcgaaatgacatgatccacaatgacaggctgatagtggtcatatacacccgctcctaagaaagaagcgtattgtacggtatcacgatttttagaggccagctttgtcagttctctaattaattctgtttctgatttcgcttttttgatttgatactcttttttatatttgacgttttccggtatatcagcaaataaatcatcgatgctgcttacgccgatagtagcaagcatctcctgtttatccttttctgttgcgggcaaataacggtgcttcatgtgttgtctcctctctccaagaaaaaatattagcgtttataaaatggtgttttgacaacctttgctttcactaattttttgcgaatctctacatctacaacagtcccgatctcactcgtttccgaatcaattaaggcaaggccgacgtttttccctaatgtcggtgactgcgtgccggttgtcacctttccgacaaacctgccattttgaaaaacctcatatccgtgccgcggtatccctttttcaatcatttcgagaccgacaagtttgcgcttcgctccgttttctttttgttcactcaatactgacttaccgaaaaagtcagactcctttttgtgctttacagcaaagcctatacctgcttcaatcggtgtaatatcccgggtcagctcctgaccgtagagcgggagcttcgcttcaaaccggagtgtatcacgtgcaccgagaccgcatggaatcaatccgtatgcatcccctgcatcgatgattttttcccaaatatgcatagcatcatcactgcggcagtaaatttcatacccgtcttctcccgtatagccagtgcgtgaaataagtgctttgcggccgctgatatcggcttcatcaataaacgcaaacggctttaatgcagacacatctgcatctgtcagattttttaagatcgcttctgctttcggtccctgtacagccaagagcgcgatttgatctgactgattgtcaatctgcacatcacctgctgcatgttctttcatccaagccaagtctttatctatattagaagcattaatgacaagcagatagcggttctctcctttttgatagataagcaaatcatcgacggttccgccatccgggtaacacatcgctgtatattgagcacggcctggcgttaacgcggaaacatcatttgtcatcaatctttgcaaaaaagacagactgtcgttccctgacacttcgacttctcccatatgagatacatcaaacaaaccggctgcagttcggacagcctcgtgttctttttttatagaagaaaattgaacaggaagctcccagcctccgaaatcaatcgtttttcctccatattccttatacaggtcaaataacggcgttcttttcagcatctaattcctcccctttatcaacggcgcagctaaaaaatatacaaaaaaggacagagaaacacctcatgtaaaatgaaggttctctgtcctggcacctgaaagtttactttgcatacgcaaagacgtcccctttggtggtttgcgcatccgcacaaacactctccagagttgcgtcgagcaagagttcttttgcctgagagattcactccgcagtttgctccttcggcgcctgtatcccgaggttttcggtcaggtctctccccttgctgtcattcgctcatattttcatgctgttatggacatactatagcaatatcttacatcaaatacatactcatatcctaccatcatcactatatgctgggcaacagcaatttgggcagatttttcttatattattcatcttaagaatcgaagaataagaaaggcggtttcaaagcaatgaatacagaaatgatctacgatgcaaaatggcctgaagaatttgctgaaagactgaaaaacgatggcccttgggcaaactgggaactgtacaagctctctgcagaaatccagaaaacattagcaattccagagtttgaaggcttacgggctcctttatatctgccttcctttacgccgctcccccaccagctcgaagtggcgcaaaaagtggttgaaaaaatgaacgggaaagcgattttagcagatgaggttggtctcggaaaaacggttgaagctggactgattctaaaagaatatatgatacgcgggttagcaaaaaaaattttgatccttgtgcccgcttcccttgtgtcacaatgggtcaaagagcttcaggaaaaatttttgattccggctgttgaacaaaagaaaagctatgtgtgggagcaatgcgatattgtcgtctcatcaatagacaccgcgaagcgctcgccccatcgagaaatcgttctgtctatcccatatgatcttgtcattattgatgaggcacacaaactgaaaaatagcaaaacgaagaactatgaatttgtccggaatctcgtaaaaaaatattgcctgcttcttaccgcgacgccaatccagaaccgtatcgaagagattttcaatttggtgtccttattaaaacccggccatttaggcagtcagaatcactttcaggaggagttcgccaagaagaaatccagtttagaagcgcatgaacatttaaaagatcttgtgaataaagtcatgatccgtaacaggcggcatgatacagggctgaattggaaacagcgccatgttgaaacagtgccgattcaattttctccatcagagcaggcgctttatgatgaaatttctcgcttgaaggacagtatcaataaaccagccagcatgttctcgattatgaccttgcaaagagaatgctgttcgagcagagaagcggtatatatgacgctgaaaaagatgcttgatcaaaaagagaaacaagcacctgccattgatgaggatacgatttcagttttaatagatcgcatcaatcaagtgacacaaaactctaaagcgcttcaagttgttgacttgatcaaaaagatcgacgataaggtcatcatttttacagaataccgtgcaacccagatttatcttcagtggtttcttcagcaaaacggcatcagttctgtgccgtttagaggcggatttaaacgtggaaaaaaagactggatgaaggatcttttccgcggaaaaatccaagtccttattgcaactgaagcaggcggtgagggaattaacctgcaattttgcaatcacatgatcaactatgacctgccatggaacccgatgcggcttgagcaaagaatcggaagaattcacagactcgggcaggagcgtgacgtgcatatttataacatggcgacaaaacatacggtggaagagcatattctaaagcttttatatgaaaaaattcatttgtttgaaaaagtggtcggtgaacttgatgatattttaacgaaaattcaagtgaacaattttgaagagcaccttcatgacattttgtatcactcagcaacagaagaagaaatgaaaataaaaatggataacttaacctcatttttgtcttataaaaaacagctgcctgctgaaaaaagaggatcttagcctgtaaggaggttttattagtgagacagcaagaggttcacgattttctgctgcgtttttttcaagcaaacagctgccaaatcgtcgatcaaggcttaggctatatgacagtgcagcttacagttgaaatggacaaacaaatcatgaaccgccctttctactggcattggcgcgagaagacaggcggtgatccgaatccaatgaaaatcacttttattacagataaaaaaaatgcgccaaaagacctagatggtgaatttatatattttggggccccgcgtctttttcaaatatttaaagctgttaaacaaaatgggagatttaccagaatgtatgagaaaattgaatcagccggagctaaagtcccacttcagccttggcttggtataaatgtcacgatttcataccagtccgacatgaaaaaggataagttattgtcactaggtcttcacctagtctctggaacgataattgaagattttcaaagcaagctgacccagttttcactgacgtctcaaatatgtgactattgcttcaccatttcacctatgatcaaaccagaaagcggacttaagcgtatggaaaactatatttccaaatccgctatgcaggagccgtccgactgggcggaacaggcggttaacaggtggaagaatgatatgacattgcttgataagttttacgagcatatagaagaaaaaccagaagaataccatctagaaaaacaggcgctgaaaaccttgtatcaaccaaagatatcagttgaaattgaaaatggcggattgttttatctgcaaaataatatttcaagctaacttttttaccattcgacatcattctcgttttttttgagaaaatacgattataataaaggtatattggaaaaaaattctggcgatttaatggcaaatgacttccagagactaatgaagcatacaataagtcatggccggactggctgaaatacataaacaagtattttaggaggagaaactgcatgaagaatgcaaaacaagagcactttgaattggatcaagaatgggttgaattaatggtggaagccaaagaggcaaatatcagcccggaagaaatacgaaaatatttacttttaaacaaaaagtctgctcatcctggtccggcagccagaagtcataccgtaaatcctttctgaatgtgctataatatcacaaggaaggtgatgacattgattggccagcgtattaaacaataccgtaaagaaaaaggctactcactatcagaactagctgaaaaagctggggtagcgaagtcttatttaagctcaatagaacgaaatctacaaacgaacccctccattcaatttctcgaaaaagtctccgctgttctggacgtctcggttcatactttgctcgatgagaaacatgaaaccgaatacgatggtcaattagatagtgaatgggagaaattggttcgcgatgcgatgacatccggggtatcgaaaaaacaatttcgtgaatttttagattatcaaaaatggagaaaatctcaaaaagaggagtagtgcctgagcagaggcactaactcctcttttgtcaataaacatcgagacggcccagtatatgaatactgggccgtctctttttattgctgttattaatttttatcctcgctgtgcgctttttcattttctttcacataaccgtctttatcagtatggtcctttttgattgtcaagccgttccactgtgtagcttcgaacgagaattgaagcttaatggagttgccttgatatttattttgaaccataagcccgttttcatcttttgttttatcatctttgaattggatttccatttgaacctgatcgaagtcagttggtgtttttggaacaccatcatattcaggagcggttttaccgtcaattgttgctacattgactttaccgcttgcatttaagaatttagggtcaatttgttttttgattttttcagtagccgctgcatcatttttagcagacatcaaatacaagtctttaaggttcgcatcatctaaaataatgtttttcgggtaaccattgccgccctcttttccaactgtcaacaatgtcacttcaaactggctgaggaaatcttctggagatgtattgctgccgccgtttgctttaaaatctccataattaagcgccattagaacttctttgatcgcaagtgatccgttattttcaaattggaaatcctttgtcaacttatctcccggctttagatttgataagttcacactcgctgaattctctttagcagataaatcaagcgtacctgatgcaaaagtagcatcctttgatttaatgtcgttaaatgctgcccatgttcctcctccaactaaagctaatcctagtgctgcagaagcaactcctaaactcaatttctttttcatacccatggtaaactccccttttattgaatgattttatatcgaaacctgttgccaggtttacaactgaagttaagtagacatggtgctgtcctttgtatctgtttccaaggcttttgtctttctttcaatttctctaatggcgctgctgatcgtcacaaaagcgtaaactaacagcatcacgccgggaacaatcaataatacagccgttccaattggctggctggcaaaatgaagcatatagccggcatatggaagctgaaaacctgtgtattgcgcgcgaacattttcgtccgatacaggcgctgaatcagctgctgcattattatcaccttttgttttaaataacaaatggtcttcttgctttgttatgtcaacaattctgtgggtgaccgccgtatttgcatcctgcataaatgtaataacgtcacctttttggagctctttcacatcagtgatttctttgaccaatattaaggaacctgtattgaactccggctccatcgaacctgacagaactgatttcagcgtatacccaaacactgccggctctcccccggatgaacgtgttgaaatcacgacaagtgtcagcacaataataagagtaaagatgatcacgtataaaatattactgatcagcttcattgcttttttcatcctcttccccgctttccttctggtctgattgagtttctttttctttggttacagcttcttgagatgtttcttctttcattgttttttcctgtatatctttttgtgttgtttcattctcctttttgacgtccggctttgtttcttttttagggactgtcggtttttcatcgcattttgcaagcctcataggctccgaccactcaaatgtactgccgtttgccgggtagcctgccggtttatatactttaaatgcataaatgccaggtttcatttttttcttcgtctcaattttataaagtgaatcgccaatttgattggagacaaatcctttttcgatcacgttcccatcctttaacggtttgcgggcattttcaagcttatgaagctcccacttccactttgatttcttaagtttctcacctgtattttcgagcacagcaaataaggcgaaaggtgagcatacagtgcctttcgtatccgtttgatctgatatgtgcaaatcactttgatcccagcgtttatcataatggcagtttttatctgtatgctgaaagtctttacacgtttgaagtgagacatcaaatgtttcaatatcatgaaaagcagcgcttgtatcatcggaaaattgtaagcatagtgcggcagtcagactgaaaatgactgaaagctgaaagataagcagaactttcagtttcgtcttcgccttttgctgattgtgaaacaatcgaaacatatcttaccctcctgtaaaacactgtaacttgatatgacaatcgttctctttaaagaactttacaaatagagtataatcaacgatttatagatttaaaaacaccgaaatcgctcatttcgttcgtttaaaagaatgttttcatcatattacaaagtcttgctcagtattgctcattttttcaattttttgaaatttttgggattgttatgtgagaatttaaatgcatatcccattattatttggtaataataaacaaagaaagggtgacagcatgatgatcaaacaatgtgtgttttgtctatctcttctcgtctttggcaccacagccgctcacgcagaagaaacaccgcttataaccgcccgccacatgtccaaatgggaagagattgctgtaaaagaagcaaaaaaaaggtacccgctcgcacaggtactgttcaaacaaaaagtatgggaccgtaaaagaaaagatgaagcagtgaagcaataccatttaactctgagggaagggtcaaaagaattcggcgtttttgtgacgatttcatttgatccttatagccaaaaggtcaataaaattgccatattagaagaatatcaataaggtcctccattttttgaaggaccttactcgtttatttgcggttattttttccgtttcagccaaagtcggaagccatagggtaaaataccgaaccactgctgggaaacaggcgtttttgtttctttccgcacctcttttcgttcttttcgctcatctctcggagtatctatatatttgacaaattgctgcgtcatatatttaacataatcattcgttttcacgtgatcacctcatcattcaattattatgagtgttgtctcacatgactttttttataccctttacactgttttattctgtccatctcagcagttttttctgtttttgatcaaacacgatctgtgcagttctttctgttcccgactccgttgacactcttaagttgatttctttttgctcttttatcgatgtatcatgaatgtaataagaaacccgtccatatggaaattgctgcgtaccctcctggcctttccgttcctctagaacatgccgaatcgaaagaagcaccccattttgaagcaaattctctcctatgtataactcttttgtttccttctcaaacatgcagcgtgaaatatattgagaagcagcaaagttcacgattaacagcacaagcgctgacacaaaaagaacagctggataaataaaccctcttgtacggtacatttacccccctcctaaatacgaatagactggaaaagcagtttgatacactttttggtcctcactctcaattttcagcaaaacaacaccatttttaatatcagctttcatggcagtaatatgatctaaaatcggaacatgccctttgccatccactctttttcttatcattgaatgataaatttcgaaacggatgtcctgcccggaaagattggtgcagattaacacgctcccatgctcggctgtcttaactgcctgtgactccttgcattcattcatcatctgttctatcgaaatcatccattcttgctgtgtgaaaccgtcatgttcctgctgtcgagacaaaaacagatggaaaatcgcagctaacgatcctgatatgagcaaaaagactgagagcgaaaataatacgttaagaagcgtgtagccattctgtctgcaggatgctgaggcaaaatgatttttccttataagctgcggctttgatacatacgttttgatattcgccctcctcctcccacttcattgcatagatatgattgttctttgtaaacgtttttgacgcggctccttcaccactcatgacatatttgctaatgctctcattcatcatctgatagccgatttctcgtgattccgccattttttcatcagctatcagcttgtcccacaaggggacgactgtcagcagcacaaacagccacaggcttagcgcagacattgtttctattgtagaaaaacctttattttctctccacattgactctcccgctccctagataaactgttatgtcataaacggcatgcccttttactcgtatttttccgcctgcattcgggtgccctttctcattaaattccaaacggtcttttaatgtcagcagttctatagaaaatcccgttgcatacggacgttcaatgaccgtatcaccaatgactaattgatattcttttttatgaaagagaatttttgttctttgttgacgggaaatagcagtctgctgtgtgagcataatatcacttttcagctgccttgctgcctgtcggacagctgtattgtcataagcaggaggaagtgtagtgaagacggccaccaggaggatagaggcaaggcttaacacaagcaaactttctaaaagggtaaacccctcctcctcgtttaatttaatgttcaaccttaacttctccgccggtgatgataatgtgcttcccatttggacagacagcatcctttttcacatagccctctgactgtaaatcggcaaggctcggagtttgtccctcatgatcaagctcaaatgcagtcatttgtgccttaaccatgttttgtaagccttcacagccttttttttgaatggtttgattatgttttgtgacgttcggtatcgtaattaaaagcaaaatcgaaataataaagagcacgattaacatttcaacaagtgtaaatcctttctcattcatcagcctcttcctttcacatttgattcatcatctgatacataggcacaagcatagataaatacacaagtaagatcatcgctgcaacaaatccataaatcattggctgaaggatgcctgtccatttttgcgctttgtgttccagccgctgtaatatgaattggctgtatgtgaaaagctcccgatccaatcggccgctcagctggccgtgagatatgacttttgataaatcagtttcataaaaagggcttccacaaatagcggattcaattgactcaccggcttttagccgttcaatcaattgttcagcctcgcagcggtagaaagggagaaacgtttgatgtttaaatgcattaaggctgtcataaattgagaggcctgattttaaaaggctgcttagctgcaaagaaaaaaagtagctgttaaacagcttgacaagctttccaaccaaaggaatcctgatacaaatcagcatttgccgggcaggtgattttttcttaaacacaagccaataataaatcccgatacctgctgtaaaaagaacaagcaaaatgatcacaagatcaatatgctgaaaaaaagcaaaaagcatatcggttgaacgtgaggtttccatattcatcgattgatagataccggaaaactgaggaatgatgatggactgtaacatataaaacatgacagcgaccgtaaagatgaggaaaagcggatagcgcagcactcttttcagctggtctgcctgtgcaatttttcgttccagcagctctccgctctggatcatggaagcaggcagttcaccatgtgtttcagcaaaataacaaatacctacggcttccttatgaaatgacaaactctttagtacttgataaaacggagccccttccctcaaacaagtgaccgtaccagtcaagtcagccgcctgcctcttattcatctgaagttccatcaggcgtaatccatccagaagcgtatatccccccgcagtcatttcaccgagccgctttaataacctggcttgatcctttaatgaccagacttttctaatctttttcatgataaacccaccggtcatagttgtttgtcgttaaatagccgagcgcaattccttttctgataatttgacgaagcgtttgatattggtaatttgcatgatttccttttgcctcctggatacattgctgaagatttttcccgtatagaagctcataaacgctagctctcctggtatttcgtgactgtcggcaatacactgatgaacatccgttttcacaaaacgggcaagccaaatcaaccaagcgctgagccgctattgcaatgacagtctgttcgatttcattcatattgataccgaattcaagcagtctgtaaatggcgccctttgcgtctctcgtatgaaggctcgttagtaccagatgtcccgtcatcgctgcccgcaccgcaatttcagctgtttccgcgtctctgatctcacctaaaataatcatatcgggatcatggcgcaaaattgctttcagacctgcagaataagttacaccggctttttcattcacctgaacctgaagaacatcttcgtcccttgtttcaacagggtcctctaatgtgacaatatttcgattaaagtgtttttttgcatattgaacgagagagtataatgtggtagtcttccctgaaccagtcggcccggtaaaaatgagcatgccatgggaatgttttaaaaacgagagtaatgtggctcctgtcttcggaaatagcgacaatttatcaatcgaagggatattgtattggggcatcactctgatcacgaggctttcttcattaattgtgggcagcgttgacattcttaaatgaacatttccctctttcagctttaacgtaagcgaaccgttttgcggctttcgcctttcacctatatccattgctgaaagaaatttaaaatgtgaaatcagtcttacgcactcttcttttttcatgtccctttttttcagcaaggcatgatcgacccgaaaatgaatgatagcgtcccgctccctcggcacgatgtgaatatcagaagcctttgttagatatgcttcttcaatcaagtttttgcttacattttctattgaatccaatttgattccctctcctttcaatgcgtattgtagaaaaagaaggagcggtaatcaaacagggaaaacgtgattttgtgagatgttatatgctgaaaaaccaattctttctggcaagaaaaaaactttcaactgaatgtgcccctttcattataattttcccaataataaaaaagcagacatggtcaccatgcctgcttgattccattttcattatgctgttttcgctttttgaccagtatctttctcaacggaaaggtcgcctaatgcaacaataccggtcatttggtcattttcaagaatcgataaactgcggatttgatgctctgtcataagcgccttgacatcgtatccggtcaccctgatatgtctggtgaaaaagcggggcacgctgcacaaaatatgaaacatcctatagagtccgcctttttcgaggtttctttttcttcttccgctcctgcagcatatctcccgtccagccttttttcctcaaatagagatagatcagaactgtagatgtgacaatcaataagagagaaaagagatatccgtatttccaattcagttccggcatcactgaaaagttcatcccccataaggcccccagagctgtaatcggcgtaaaaagcgtcgtgaaaatggtcagcgcttttacaatttcattcccctatgtgaggtaatgacttcctctgaatgcagcagattgttaagctccccttcaaattcgctgatgtatgtaaatcccctgtcaatcttcagttgtgtccgctgataatcctttttctcttcattttgaggtaaaaaggtttctttcaacgccatttcaatttttttagcgcttagtatcaaatttttccaaatcatcagttcatggcgcaggagatggacgcggtttaaaatgcttttgctattgtcgtctttaatctgccatctaagctttctcagctttacttcaaattcatcaacaccgattaaatacgcattcattagttcgccgagaagaattaaaaacccctctatcgcattgtccgctctttccatttgccggacaacttcttttcctttaatccctctcaaaattgaaaagtcaaagttgattgtaaaaaaatattgtctggtgatataaaagtgaaaaacagtatgatctttttcttcaccaagcccctgatcataaacaatcgacccaaataccgcttcattttccgtttcagttgtatctactcgtaaaaaattaacgtgatggttattttcaaaccacttttcacactgaggccagtgagaaaaatggattagatcccttgccttacttctttcttgaggccccatttggtaccaaaaccaatcctttcccgtatgtgccttcatgtcaagctcctccaaacttttgttctttattctttaatttcccaataaccgcgtcactaaaccagtctgccgcttcaacacatgttttatgagcattttcaggtggtatggaatgtagaaagacatcggaaaagggaggtgcatgccttccttggagaaggcagttgttttggaatttgtcaatttactagcagtcgctattctcattttgttaacaggattttttgttgccgtagaattttcaatcgtaaaagtgcggcgatccaaaattgatcagcttgtcgcaaaaggaaagaaaggtgctaaagcggcaaagcatgtcatcactcaccttgatgaatatttatcagcctgtcagctgggcatcacagtcgcagccttaggactgggatggcttggggaaccgactgtgcaaactctgcttcgaccgctttttcataaagcaggcttaaatgaatcgcttacccacctgctttcactcgtcatcgcatttttagcggttacgtatttaaatgtcgttatcggggagctggcgccaaagagtttcgccattcaaaaagcagaaagcattaccttgttgttcgctaaaccgcttatttggttttataagatcatgtttccattcatttggctgttgaaccactctgcccgattgattacaggagtgtttggactaaagccggcatcagagcacgagctggcatatacagaggaagaacttcgggtcctattggctgaaagctataaaagcggcgagattagaaaaagtgaattaaagtacatgaataatatcttcacctttgataaacgaatggcaaaggaaattatggtgccgcgaaatgaaatggtcagtttgtcactagatgaagactccatttcaaatcttcaggaaacagtcaagcaaacaaaatatacacggtacccagttgtaagagaggataaagataacgttattggcgtgattaatatgaaagaagtgctgttttccatgctgacgaaagatttttcaatcaagaagcatcaaattgaacctttcgtacagcccgttatccatgtcattgagacgattcctatttataaactactgctgaaaatgcaaaaggaacgcactcatatggcgatcctcatagatgaatatggcgggacgtccggtttggtcactgtcgaggatattatcgaggaaattgtaggagaaatccgtgatgaatttgatgcggatgaagtgcctcatatccgcgaacttggaaaggatcattacttgttaaatgcaaaattattaatcagcgatgttaacagcctgcttggaaccgatttatcagaggctgaagtagacaccttgggcggctggtttttgacacaaaacatagacgctgagcctgaaagtaccatagaatatgatggctactcttttaaggtaaaagacatcaacagccatcacattttatttatagaagttaaaaaagctgaatagcccgtgaaaggctgttcagctgctatctttcaagataaacatggcaaaggcatcaacactcttttattttaaaccctttattggccagggctttagcaagactttgctcggttttcacattcgaaaaatccagacccagcttcacgacagtttgggcaatttccggcctgattcctgaaataatcgtctcaatgccgagcaatttggtgctgtcaatcactttaaaaatttgataggctaccatggtatcaacgataggaacgcccgaaatatctaaaaataaatacgagagctttaacgctgagcactgctccagcacagactccaaaatcgtcctcgctctgtgcgtatcaatttcaccgacaagcggaagaatcccaattccatcagtaatcggcataatcggcgcactcaattcattaatcatttctttttgcgcgtttaattgtatcatggtcacctggtgatattcttccgtaaatacttcgatgatctcatcaatgttttgattcaagatccggctccactcataaaattcctgaatgctgatgtcttgagaagaagcttcgctgaatttctgaatccattcaaacatgatgtgcctgaaggtgttaaactggccgacactttgtgtaaccgtcacttcatgaacggcacggtctctggcgcattgaagagaccaccggttgagctcatcctctacgtcttcttttctaagggattttgctacgatggtcaccaataattcatgctggtcttttaacttttgttctagtttttgctgatctttcgctgaatacagccagctgccttttgacgtacaaacttccagccattgttgcgtgatatcttctttgtgctctgttaagtgctgatcaagagctatcatcttaatgagctccctcctgtttttgaaaaatgtacgctatatatgtataacgcgtctgcctttacacatactatgtttagattcaatgggctatagccaagcggtaaggcaatggactttgactccgtgatcgttggttcgaatccagctagcccagtttctgaacaggtgaaaaaccgaagataagctgattcgaataaatcagcggatcttcggtttttcatcatgcagattgatgaaccgttttcttcttcgataacttcaacagttctcccgggttataaccaatcaccagctttttgttgtctactagaatcgggcgtcgcaaaagcttcggcttctcgattaaaagttccagcacctcatttaccgtcatttcttcaatgtttaaatttaaatttttgaaagtctggcttcttgtcgccaaaatttcatcaattccttctgtcgttaacgataaaatgtactttaattcttctcttgtcggggtttctctgaataaatgccgttcgttaaattcaatttgatgtgctttaagccaatgttttgtttttcggcatgacgtgcagcttggatatgagtaaaaagttaattgttgttccattcgttttttcctcctcagttaaccatctctttgtagaataactacccggatcatttttcatttaaaccatttacagaacttttttcggattattttttaaaaaacattcatacaatagaaaacacaatcaaagggacaaattccatttgtatattaataatgaaaatgtttacatttctaggtgtgatctattataataacagtcagagggactctcgggaggggataaaaatgaatcgcatgttccgggtgttaggattttggacgggaatttttgcagtcatgttttatttaggtgatatgaaagatgcttcccttttattttttggacagacgatcttattcgtgtttctatcgtatttgaacttaaccgaacgcatgtatatttatatttttggcgcttatttaacaattttcttcgccggctttacatattactcaatttttattatggtgcccggcggcggaggccattaaatgcagaaagagacaaaccttatcggtttgtctctttttttacaatgaaaacccatttaaaaacggattttggtcctgctcagtcagtacgtttgtttcaggtccatggccgcttaacaccagcgtgtgttctggaagcgtaagcagtttttcatgaatggacgtcagcagcgtctcttgatcgccgcctattaaatccgtacgtcctataccgccttggaacaaaacatctccggagatgaccaagtctgcatctttcacgtagtaagacacactgcctggtgaatgtcccggcgtaaataatgtttccaaatgaaacggcccgatattcaactcaccgtcgccttcaattagatgatctgcaggcttagctgtgacttctatccctcgcagcatgccggagccgtttaaagaagcgtccgtaagccaatttttttcattttgatgcaggtaaacagggatatcccatttttctctcacttcatcaagcgccccaatatggtcaaaatgggcatgtgtaagcaaaatggctaaaggcgtcagccctttttcttttatgtattgattgattttatgtccctcgccgcccggatcaaaaatcaggcattgatcatcactgatgagaaaatatgcgttcgcttgaatcggccctactggcattcgtctccatttcactattatcacctctttcttttttatgctcttattatgagggttttttaaaaaagattcaaacaatcgcaatgaaaacgctatcgacaaacctataaaaaacaggtagaataaaactggaaagaattgcaggtttttcaatgtaaagggggctgtgttatgttacttgtcgtgattttcggccttgtcgctcttttcgctttatggggagtcttgcgttctgttagaaataaaaatatactcgggtttttattagccggtgccaccttatttgtctttggatggtttaccgtgatgaccgtaataaacagcgggtatccaaccgcacattaaaacctgtatccgatcggatacaggtttatttttatggctgtaaatgtttattgacactttctattttgctctcaagcgtcgtttttttgtcacgcctgtcatcgatacggatattcgttgccactctgtgcaatcctttttgaaatggcgcttcgtgaattgcctgaatgactgcaaaaaggtcactgagttctccctcgatcagcgtattcatcggtgtcagctgatatttgattttcccttctgcttgatatccttctaatatcttttgcacatctgctacgtaagcactgacactgggtgtttcagtaccgattgggataatggttacatctgcgatagccatcgttattccatctccttttgatcaatgatgagttgcttcgtttcatgtgatttcaataaaataatttgctcaaaatgaaagccgtataacgcatatttcccgttcggagatatttgaatcggctccatttcccgcagagacacaagatcttttgtctctcccgatgctacattgactgctgcgagcttatatgcatcgccgctttgtttgaatgtataaaacaggcctcctgcttcatcatagtcatactccattggagacaaacttgtatatttcgcttggagcggccatttcgctgtaacaggtgatgttgattgcggcgttttaaactgatacgtcccttttcctccggaagctgatttgacagtaaaactcattttatggaaagaatcgaagaatagaacgtcatcctcaagcttctgtttcgtcttagaagctgtatcgaacgtatataaaggccctgttttatcgtctcttccctcttttacataatcaaatgtatttttggatgtccaatgaatgaacggaacctgtaccgggcttaagaaagattcgtcttttttagcattcacctgatatgtatggaaatcccagttttcattgaattccgtcaccatcatttgataaggatcatactgattccaagcagcctccagctcatacgtttcgtaatctttttcgtaaagcgtctctccttctgcattaagcaaaaccactgccgtcttttggctatgtgtgatttgcagcagaatcatctgctccctcgcattgatttgaacatcaacgatttgaccatccgtttgatagagctttttcgctttgcctgtaaagatgcggtatgcaaaaagctctgttttcgtcggattagacgcagtatataatattgtgctgttattcagccagccttccgcaccatccgctttttccgcggaaagcggtatgatgtcttttttctcatcttttgccgccgatgcctgtttttgctgctgatgagatggttcgcatgccgataaactaaacagcaataccgccagcagaataaaacaaactgatctcatcagcattcccctccgatcatctttattctctcatatttgcttcggcagaaaaaagaaaaagtttcagttattcataaaaaaataacgccctccacaagatgccgcttgttgcgttatatatgtgtgaaaactgctgaaacggcaaaggattttggccttttccaagttccaccgtatacccttccttaaaataatggtgaataaaccaatctcgaaatccagcatagctgtctatatcccttactcccttataaatgttcccgcttaactcctcaaaatcctttatgacggcagcagattcctcaggctcaaggcctttatagccccaataaatttcttctccttgagtatgaagagccagcagtctgtcaggcggattctccgtgatcagccggtacatcgcaatagattccggctccgtaagcggagagattcccggaaaatcgcggtagctgggtgctgtcggttttcggtatttttcaatttcccataatgatggaaattgtttatttaaatcaaccccgtttatattcgccttccattcattaaaattcggacgatgttcatttagcctttcgagctcatctcttctggctcccatgacttctgatccgtttaaaacaagatcaacgccatccggattgacaagaggaacgagggataaggatgtgctgttaaacagcttcataggagaaaagccaaagaaaggcgaattgcagcataatgacatacagtattccttaaaccattttagcaggacagacgttgtaatccactcattcgcatgaaatgacgcgttcatatggaccttttttacggcatgctccccaccagccttcagctcccagataggccttccgagtacagaacggccaatttcccggcatgagacaaacggaaaaacatcaataatcttctttatttccttttcaacagctgaatcatcatagattttctcttgctcaatccagctatcagaaagtttcagctgccgaggctgtaaaaagcgctttatgtcctgaatggtttgaagctctttgccgctatgctcctctatcacataaccagggcaatacaattgatgtttttgtgcggagcgatttgcacttttaagcaattcctcgtctatcttcagttctttcgccactctggccaaattgttcttgatctcaggtttcaccgtaataaacgccatcatcatccccctttttgttactatatgacagcgtatttaaaaaaagaaagcctcccgctcactttgacgcgggagacattgtgattacgatgcctgatcaagcatttgtttttctttccgttttgacgaattgtccagccttttctgatcataaaatcgcaacaaatccccataaatgatttcatcagaaagtgatagctcctgttttgctttatcagcaaatgcttcacattgttttgtctcttctaacggttttcccgtctctttgtcataacacgcaccgtctgtataaacaacctgatctgtgataaaactcccgtctcggagcaccgtaaagtccagtttttcgtctgaaagcagatcgttgccgaattgaatttgatctttcgtatcaatccctaaaagattcatcagcgtcggcctgatatcaatctgcccgcctactgtttcaatggtttgcggctttttatcagtaatacccggaatatgaatgaccagcggcactttttggagctgtacctcttcaaatggagttatttcttttcctaaaaactgccccatcgcttcattatggttttctgatataccataatggtcaccgtacaatacaattacagagttgtcgtataatccgtcttccttcagcttttcgataaaccgtttcagcgcctcatcctgataacgcactgtcggaaaatatttatttagcgtcaggctgcttgaatcatattcatcaatcaattgatcctcttcatcaagatcaaaagggaagtggttcgtcagtgtaatcagcctcgagtaaaacggctgaggcagatttttcatcagctctgaagactgctcaaaaaattctttatccttaagtccccagccgactgaattttcgtcagttacatcatacgagttaatatcaaaaaacgaatcatatccaaatgagtcgtacattaaatcacgattccaaaagctcttattattagcgtggagcaccgctgaatagtatccgctgtttttcaaaatttcaggagcggccatatattgattgcccgcattcgtaaaaaacacggcacctcgtccaagcggatacagtgaattgtccacgataaattcagaatccgaggttttcccctggcctgtttggtggtaaacattattaaagttgtagctctgttttataaagtcattcagaaaaggcgtgatttcttctccattcaatttttcattaatcacgaagctttgcgtcgattctaaggatacgagaatgacgttccttccttttgcagcgccgaataagcgtttgttggcatccttcgcattagcggttacgtagttttcaatttccgtcaggctgttgctgtctgccaacgctctctgtgcggattgctttgactgaagaacgccatcgtaaatatgaaaattaaacaggctaatgtttttaacaagcatttctctgtcaaatgagcgtgtcaatagctgaggcctttccgcctcagacaagcccaggttgaagaaataaacagaagcaacgaacaaaaaataagccgcccgttcatttttcgttgagggaatgtccgattgaaaagctttttgccggatgtgaagccatattaaaaccgcaatatctacagctaataggaggtctgtcggctcaagaagtgttccgatgctgcttccgagatcacccatattgctcgtttgaaaaagaacagggattgttaagaaatcattgtaaaaacggtaaaaaaccatatttgccagcaatacaaacgtgacaagacagctcatcgcgataatgtagcgatttctgtttttgccttttaaaaacaggctgaggccaaaaataagcaacaaaaaactcaatgggttgataaacagaataaattcctgtgttagattgtcgattttaatatgaaaactggttttgtaaacagcatacgttttcagccacatcaataaaatggcaatcagcataaatgaaatcttcgaaaaaaacgtttttcgcatttcaacctcctatgcagcacgctcaaaaaaatcagtctattcccaacattctcattaacacatcaaattaaatcttaacctgagcacaacaaaaaatcaatttcatttacacaattttaacaattttgatgtttcagccattcatttttagcgatccaagcgcctccgataacgccggcatcatttccaagtgctgcgattgaaatatcagcagcttgggctgcccgcggaaacgcgcatttgcggaatgttttctcaacttttgatctcagcagttctccggctctcgatacgccgccgccaagaacgattttggacggattaagcgagcttgccaaatttccgagcaccaaaccaagatgcttggctacataatcaaccacctcaagggcaatttcatcattttcacccgccgcttcaaacacatcccgcgctgacaattgttcggttgcttttaaacgtgtcgtctttttagcatttgctattttttcttttgcaattcttacaattccggttgctgacgcaattgtttcgatacagcccgttttgccgcagttgcagggcgctccgccttcagggatgctgcaaatatggccgatttctccgccggcgccatttatgccatgtacaatttcaccatttgcaatgatgccgccgccaactcctgtgccaagcgtcacgagaatgacgtcttttgcgccatcacccgctcccttccacatttcccgagcgcagcaatattcgcgtcattttctataacagctgggatgccggtttctgtctccagatggtttttcaaagcataatttttccaccctagatttactgtttcataaacaactcctgccgccatatctacagggccaggtgcacccattccgatgtatttgatgatgtgcttcggtttttgcagctcatccagcttgctgtcgattgtttttgcaattgtgacagtaatcgtgtcgccagttttatcagtcggaacttcccacttatgctgaatttcgccatattgattaataaaagcgagtttaattgtcgttcctcccaggtcaatgcctgcaaaccatatctcgtccatttttatcaccttagcctttataaaaatctcttccgttttttgtttgttctaattcttttcgaaggacagctgccgctctggcccactgctccttttcaatcatgtggttcatgtataattcctttaattcatccagcataaactcaatttcaagctctctgtctccaaaataaacaatgtggccaaacgtttttaacagctgctgcacatcataaaatgtattcattttcctcaccatttcttgaacttaactatcataagcgtattcatatggaagcggtcagtcaagaagaaaacgctgacaaaaaagccagcttcctttccatattccacctttatgattctttattgttttcaatttgccgctgcagctccttgtagcgctgctccttcggcttcagtttcacagccgtctggatggccttttctgcttgtgcaagctcatttttttccgcatacaataacgctaaattgtaataggaagcatggtctttaggttcttttttcactgctcgttccaaaagggaaaccgcctgatcatattcgccgatttgaatatcagaaacagcaagaattttcaaaagatcggcagaggcatctttttgcgctgcttctccgttcagcaattctgttacttcttcatactttccttcctgatacagctcgcttgcctgctgaatcagcgctgactcctggtgtgaaggcgaatgcaatccgtaatataaaaatccaacagccaaagcaatcagcaaaaccgctgacaacaatctttttccaaaggctccggctttaggcaaccccagtgctgctgcagcgaaaaagccgccaatcaagccgccgatatgtcctgaattatcaatattcgaaaccgcaaaaccaaagcccagattgatgataataatgacaataatattggttcctatggttcttaaaaacatttttcgattagacaaagcaacatacagtaatgcgcctaagcatccgaatatggctcctgatgcccctgccgaaggatacgggctgaacacaaaactcgcaatcgaacccgtaatgccagcagccagataaatcagcaaaaatctccccgatccatacatccgctcaaccgctgtaccaaccgaccataaagccagcgtattaaaggctaaatgcgctatgccgatgtgaagcacaatcggtgtcagaagccgccaccattctcctgctgcaatcaggctgttttcctttgctccaaaagcgaccagcgtctccgtattagtgctgcctccgtttatttcgagcaagaaaaacatcaggatctgaagcgcaataaataaatatgtaaaaatcggttttccattttgaaaaaccgccgcttcagtttttctctgttcttcttgtttcagcactagcgaaaggaagcgttctcgcgccttttgcgcgtcttcaaacgaagcgtgttcctctgtacaatcttctgtacgaaatgatggaaaaaccgcttgaagatcatctcgaagcatcgttcctctaacgatcgccggttcaactgacacagttcccttctcaaaagttttttttgcaatctcttcccagtcatcaacaggggcttccgttgaaaaaaacacattcagcagcttcatccttcgtctgcccaattgatgtctgactcgttctactcgttcggcctgctcttcgatgtctctaaccatttcttgacggaaatcaagatcgtgcttataaagacgaactagattatgagaggacttgtccggcgcttccagccatatttcatctgactcaccggcttgtatgacgccatacccgttattcaccaggtgcgccgcaattttccaatatgtatactccagcaaaaacatgtttaccgctccaatagttttttttcattataacagctggcgctccgaaacgcctactgaaagcaaaaaatcccgtttttcacgggattttagaaagcttgttgtataaacttattgcggataaatggaattcttaaaaacaaatggataaaagaccgcctgattcctggctggctgagtacagtattcataagacggtagcgattttgataaaacatgacggcagaaacagcgaaaatggcatatatcaaaagttttttcattatatccctcctgccaatagggtttgttattctgccttatttattctcgaatcagggacaggaaagttatgaaaaacaagaaatgatccgatcctctgttatcagcttatgtaccgggatgtcatgcggcagactgggtacgtgcgcaaacaactggcactccaaaagcaaagagacggtcttcccttcatatgcacttaaatagcgatcataatagccgcctccaaagccgaccctaaacccgttaacatcaaaacaaacacctggaacgatcaccaagtcaatttgtgatgggtttacttcttttgttttttcaattaccggctcgagcagtccggcgtaaacggtttcaagctgatcatcagtctgatatgtccgaaattgcattttcttagtgtccggatggcattttgggatgcaaacttgtttcccttcttcccaagcctgctcaatgacaggacgcgtcggtatctctaatcctctggagatggtgaccgcaatggtgcaggcattttgccactccggcagagaaaacaagtacttatacatacgttccgttttttgaagcagatcttcatttgataaagcagacagtgcctccagcgtcttttttcttaattgtgatttcatctctcatcccccctcggaatagaaaaaaagccagaacctttttcaaagctctggcttttttcttacacctcaaacagcaaagctgttattttgtttcacggtgtaacgtagattttttatcacgtgggcaatattttttaaattcaacgcggtctggattgttgcgtttgttctttttagaaatatagttacgctcaccacattcagtgcaagccaaagtaatattaacgcgcattattttccctccaaactaaaatcatttacttattcagacttatatataataccactataatggacggaatgctaggctgtttttcaatgaattgctgaattattgaagatacgctcataaagctgcaaatatgatgacataatgagtcgggggtggtggagcttgaacacttgttgtctgccagcttcttttatccggcgggctttctcccggtcttttaaaaagctgtccagcagatcagccgcttcctgtacgagcgtaaaatcagcgatgattgccgttttgtcatgaacggcataatcacaaaaaccacccgactgagaaacgacagtcagcacaccttgttccatgctttcttgcgcggcaagcccaaacggttcataagtactagggaaaacagccatttcacagtgagacagtaacgttctgatgtctttcctattgagaaacggcaggaacatgacgcgatccttcaggttatatgccgcagccaatttctcatagcaggacagagacggcccctccccagccagcactagatagaggtctggctgacgctgcttcaagatggcaaacacctttaacagctgcgaaaatcctttttccggaacaaaccttccatatgaaaagaggaatcttctattcatgcttcttggtattttccccttctcttcctccatagatgcagggctcgggataacggttaattttttatgtgacgccttatcaagagaccgcttcataaatgtgcttaatacgatcaaagcatcagcggactctataaggagccgttcggtcttgagcctgtaagggtgtggggcttctcggcacaccttcttcctttctctttcaagaccgtggattgtcgcagcaagcggaaggccaagccgttgtttcaaatactgggcggcaggggcagttgtgtcatcatgggcatgaatcagatcaaagcgtttattgtgtgataacacatggcgaaccattgtaaagttagcatcagctatgtaatcttcaaacttcgcatacgaaaacagctgcccgctcggagtacaaactgtaatgttgatatgagggtttaaataggaaatgaggcggtttaaatggacaccgagcccgcttttcggctcatcgggatgttcgggtgaaagcatgagaatgttcaccgttctttttcccctctctcataacaggtgtatgcagaaaattgcgcctcccaactggtgtgcgcttcttcaatctgaaaactgtttatatgacgaatcccattttcatcaaggtagatttcgtctgtatcggcaagcttgagagagacattcattgaattcacaattctgtattcagcccgatatacagcatcaccagccgcctgtctaatcgtccattcgcctttatcatacgttgtgcgttttgtactgacagcttcaatgtcttttcttttgatgacaatgcgcaattcttttatcatatcctgcgttttttcgaaaaggaccgcttcagccagccgcattgtttcttctgagatttcccagcttacggtcagggtgtgagcgttttgaatgatcatgtcgaatgtgtccctaaaaaaggaaagcttatgtcgtatattatagggaaatgggtgtttatccatggactcctaacaattctcctttccaatcgttcacttcgtgttcctattaaaccattacataaagaagaagcaaagaaagatttctcgacaaaatctcgtttttttcgcgaattcctttagaaactattggttttatggtataaaaaagaaggataaaaaaaatagaaggtgatgaaacgtggaaattgctattattgcgttgtttatcgtcagtatagcgctaattgcattctcatattctcaaagagacccgatgaaagatgtagaacaggaggtcgaaacactgcagctttctgcgatgcaggaaatttacaagctcaaaaagaaaatgacagtgcttgaggaagaattactggaaacaaaccttgtcattcgcaaatcaaagcagaacgacatcaatcaaaaaatcgctaaacaaatactttctaaatataataacggtatgtcagctgaagcgattgctaaagctgagcatgtatcagtggaagacgtgaatacgattatcaaagataatgagaaggtgctcgtatgacaaaacggggcattcaggcatttgctggcggcatcattttagcgacagccgttcttgcagctgttttttatctgactgacgaagaccaggccgctgctgtaaaagaaaataaaacagtaaccgaacaagacgtgaacaattatcttgattctaaaaaattggtttctgtcaaccgtgatgaatatcaaaaacttctcgattcaaaagagaaatccttaaacaatgacagcggctcagacacgaaatcagacaaagtcaaaacgtacaagctcaccattaaagacggcatgagcacggcggatgtatctgctattcttgaaaaagagggcattatctcttcggctcaagactttaatgactatgtcattgatgccggctatcacaaagaaattcgtgccggcgagtttaaagtaaaatcagacatgagtttcaaaaagatcgtaaaaacgttaacacgataaaaaaacaggctgactcagcctgttttttttcatccaaactttcctgaaatgtaatcgagcgttctttggtccttcgggttagagaacattttactcgtattgtcgcattcaacaagctcgcccatgtagaaaaaggcggtttgatcagaaacccttgctgcctgctgcatgttatgcgtgacaatgacaattgtgtatttatttttcagctctagaatgagttcttcaatttttctcgttgagattggatctagtgcagatgtcggttcatccatcagcaaaatatcaggattggtcgcaagtgctctggcgatgcaaagacgctgctgctggccccctgacagcgaaagagcggacgtatgcaatcgatccttcacctcatcccataacgccacgtcttttaatgacttttccacaatttcctgaagcttcttcttatttttggtgccgtggattctcggtccgtaagccacattatcaaaaatagattgcggaaacggattccctttttggaataccattccgatattttttcgcaaatccacgatgtccactttatcctttaaaatgttgctgccattatagttcagctcacctgcaagctttacattcggcgtcatttgaatcattaaattcaatgtcttgataaaggtcgatttcccacatccggatggcccgataatcgccgtaacctcattttcataaatgctcaaattgatattttttaaagcatgatgctgtccataccataagttcattccattgacttgatagacttcctgtttcattacagcttcggtagcaatactcattgccgccctcctatccgaatttcccgttaatataatcctctgtcttttgctttttcggactcgtgaaaatctgttcggtctgtccgtattctacaagctcgccgtttaaaaagaatgccgtccggtcagaaacccgcagagcctgctgcatattgtgcgtgacaataataattgagtattctcttttcaatcctgtaattaattcctctatttttgcatttgaaatcggatcaagcgctgaagctggttcatcaagcagaagaacagccggcttcatcgcaagcgttctcgcgatgcataaacgctgctgctggccgccggataacgagagtgctgatgaatgtaaacgatccttcacctcatcccagagcgctgcttttgttaaactttcttccacaatttcatctaaaacggctttattccgctctccggcatatttcaatgcatgtgtgatattcgcatagatcgatttcggaaatggatttggtttttggaaaaccattccgatttctcttctcaagctgacaacgttaatattgccgcccaatatatttaatccttcataaaggatttcaccttccgctcttgcagatggaattaaatcattcattcggttaatatttctcaaaaaagtggattttccgcatcccgacggcccaattaaagcagtcaccgcatttttttcaatatccatgtttacatgatgaaccgcttgtttatttccgtaaaaaatagacagatctttgacctcaagcacgtggttctgcttcggaacaataacagctcgctcaggtttttcttttaccatttgttcagacatgtttttcgcctctttccgttctaatttgccgtaagctttttgtagatcatcgtgccaagccatctcgctgcgagattaaacacaagaacagaaatcaccagcacggcagaaccaccgttggcaatcgcttcagcatccggaatcattccttgtgtattgacgttccaaatgtggaccgcaagtgtttcagcgggcctgaaaatattaaacggtgatgtttccgaaaacgggttccactccgtaaaattaagacgcggtgttgtcaggcctgccgtaaataataatgcggccgcttccccgaacacccttcctgacgctaaaattgctcctgtgataatagaaggaatcgcacttggaattaaaaccgtttttacggtatgccagcgtgatacacctaaagcgagagaggcttccttcagatctttagggactgaacggatcgcgtcttctgtcacacgcaccatgacaggaaggttaaaaacagttaacgcaagcgccccgcctatgatcgtatatccccagcctgttaagttgacaaacatcaataatccaaacatcccaatgacaatagacggaagagatgaaagcacctctatacatgttctgatgaagtcagttactttgttattaggcgcgtattcagccatgaagactccgcctcccacaccgagcgggattgtaatcagcattgtaataaacaaaatataaaacgagttaaacagctgatctcgtatgcctcctccagctgcaatggcgctcgattttgttgtaataaattgaaaactgagctgagaaacaccgtttataataatataggaaaacaaacctactaaaatggcagcgataatggctgcacacaaaccaaacattccggtcgccagtttatctgttattttgcggttcattacactttcctcctagatgacaagtagcgaataagcaggatgaacaggaatgacatcaccagaagcacaagccccattgaccacagcgtattgttttcaacacttccgtatgtggtgtggcccatattcagcgtgatgatcgttgtcagcgttcccgcagtgtcaaacaggctttccggcaatactcttgtatttccaatgaccatctgaacagccaaagcttcaccgaacgcccgagccatgcctaacacaacagctgtcattaatgttggaaaagctgcaggcacaagtacttttctgatcgtctgccatcttgtcgcaccaagcgcgtaagaaccctctcgtaaactcttcggaagagaagccattgcatcagcagaaatcgatgtgatcgtcggcagaatcatgacggaaaggacaatcgttcccgccaataaactgtgccctgttccactcgatttgaactgggcgataaacggcaccaatactgtaagacctatgaatccataaacaacagatggaataccgactaaaagctcaatcaccggctgcagcactttctttccccaattcggggcaatctctgtcataaaaatcgcacctgcaatgccaagcggcgcagcgattagagcagaaagaatcgttactgcaaatgagccaaaaataaatggcagcactccgtatttcggatcagtatctgtaggattccaatttaagctcgttaagaattcaattgggcttacaccatttacaagaaaagattgcagccccttcacgccgaggaaaatggtgatcgcaacagatgccgcaatcataatcagcgcacatgctgtcacaatcattcttccccgaacttcatccaattgccgattttgccttgagctgattaaacgctcgctcacagacatattttctctattgtttatcattgttttacactcctatgaatgtgttaagaggagaaacggttgtccccgcactcctctttttattaagatcagctttgcttcccgttggcatcgcgtgtcactttcatatcagtaaccggaatgtagccttggtcagtaacaatgcttttttgaatgtcttcactctttagataatcaagaaattctttagctaaacctgtcgcttcaccttttgtataagaatgctgataagcccagatcggatactcgccagttgctacatgtttcgcttcaggtttaacaccgtcaatagatagagcagttactttatcatctgttaaatatgagaatgcaagatatccaatcgctcccggagtatcagcaatgatttttttcaccgtgttggaggaatcttcagtaatgccttctgcaggttcttctccgtcaagcgcatattttacaaatgtagcacgtgtgccagaagaatcaggacggtttacaagtgtaatcttttggtctttgccgccgagctctttccagtttttaatttttccagtgaagatttttttcaattcatcttttgaaatatccttcacaccagcatcagggtttacagctgctgccataccaactacagcgacttgatgatcgacaagcgcttttgcatcgatgccttctttttcttcagcaaaaacgtctgaattcccgatctgaacagctccttcagagacttgagaaagccctgttccagaaccgccagcttgtacctgtatatcagcatcagggttttcttccataaatttttccgcggctgcaagtactagtggctgcattgccgatgaaccagaaatggttaaagaacctgatgccttttcttctccttttgcagaatcgctattcgattttttactttctcctgcatttccgcatgcagctgcaatcatcataaaagcagccatcagaagcataagcatcaatttgttttttttcatttcctgaattccccctgcgtataatgtgtaatttgtcctacacgtatagagtaaaggttctatgtaaaaagggtttgaaccgaatgttaaggttttgtaaatcaatgcgtttttttgtataaaaaaaacgcccacatcatgtgagcgtttctttttagttatcagaagacgttgtgttttctgcattttcttcaattttgtctttattcttttgctgagtatcttctttgtcctgcttcgatttcagctcaaaatatttatccattacttccctgccgatttcgtttgtaatggtatatttagcgctgtaatcaatataagcccaagggactactacagagatcgcaatctcaggattatcagccggtgcataggcaacaagtgtcgtattataagtcgctgttcctgtttttgatttatcaggtccatcatagaacgattgtgctgttcctgttttaccagcaggctgatatgacgctgaagcaaattggctggcagctgtcccttttgtcattacccgtctgaatccggcctgaacctctttaatgtattcactcttcatgtcgattttattcagcacttccggctgaacggattgtacgacagcaccgatccctcttttagcatcaggttctctgacttcctttacaagctgaggctttaagcgatatccgccgtttgcaatcgttgatacgtattgcgcaagttccagcggtgtatacgtgtcgtattgcccgatcgcatagtcaagcaagaatcccgtcaatctgtctgttcctttatagcctgtcatttcattcggaagatcaattccagttttgacacccagtccaaattggctgaagtaattacggaacgtatcaaaggccgtcgtatcaatcggtaaagcttggtgcggtttatattcaccttttccgagcgcgatcgctgttttgaacataaatacgttggaagactgctctaaggctctttgaatgttaacaggtcctaaagtagtccaggattttttaccatttttatcctgaccgatatacaatggttcatcctgaaaaactgtattcaggttgatggcaccggtttgaaggcctgtcaagactgttgcgcctttgaccgctgatcccatggcataagatgacgtcattgtacctaaagcgtaatcatcaattttatatttcccattttcttgtttaatctgcttgcccgccattgaaagcacttcaccgtttcttgggtccatcatcacaacgaatgcccggtctaacaattgcgtgcttggtcttgctttagcagatttgaggttcttctcaatgattttttccacttctttttgcaaatcaatgtcaatcgtaagcacgagatctttaccggctttgccttcagataccgtttttgttcccgtgacattgccgtttgaatctgtgatattttcgactttggctttttggccctgcagaaggctttcatattggtattccaaatagctttttccgaccctgtcattacggctgtagccaagcgacaggtaatgctcgagcaagttggaaggcaatccttcattagagctggaaacacttccgagcactgagcgaagaaggtttttatacggatactcacgttcccaatcggacgtgacatcaacacctggcagttcgtctaaatgttcacttaccactgccatttccttcgctgatacatcttcgtttttgatatattgaggggtcaatgcatagcccgaatccatctgtcttttgatagcgaggatctgcatatctttatccgtcaattcattcaactgcttatcagtaatccgttttagctgaagctggtataaatcgtcatcggatatttttttgtcttcaacctgctgtctttctttagagctaatgagcttttttgcttctttcggtctagtcaaaatccaataatcttttttatcccgttctgttactttttttgtatcgactttgatcatgtcagacagcttttttgcgatctttaagcgctgttcttgcgtggtcgatttagatctcgtgtatgtgattgcatttaaagccttatttgtcacaatggcattaaagtttcgatcataaattttcccgcgtggtaccgctgagctgacttcactttgttcctgcttattcgcttggtttttgtaatcatcgccttgcacgatctgcttgatgcccagttccacaataatccaggtaaatataacaaaggcagctaaaaataaaatattcagccggatcggaagcgacttctttttctctttatgattttgcttttttggtttatttctcctcataacatcaccttttctatttacagaaagaaaagacactcaagtaagagtgccagttttcattttaaaggttttttcgacttttttctacagataaccccttttggcaaaaaaattatctctcgccttttaacagggtcggttctgttacccgtttttggccgtcttcttccatggtttcattttccccttctttctccttaaaacggatatccttgacaaagtaataaatcaaaggatgtcctatacccaatatcgcaagtgacaaaggaattcccacatcctctttcagaagggccacgatcaggagaaagcacaaaatggaaacaattctgccggcattcaagaacatttctctaagcacgatatattcaattcttgcttttctggcatgcctcgcgcgccctatcacatcatatgtaagtgatacatatggcacaagcaacagaggatagccgatggcaataaaaacgccgtacgttaataatgtcgaaaagctcatatggaacagaatcaaaaacagcgcgccatacaaaataagtccgcccagcaaaatcgatttttttctcgcctttttcttaatcagcctggatgcaaagtagtaggcaaagaaagaaacagctgaattgacaagaccgaatgtaccgagagcaagttcgctgtttgtctcaataaatacaaacacactgattaaaaagacaaaaatcccttctctcaaaccctgaaaaaaatgcgcattcgtgattctccgccaattcatattgctatggcgctctccaaatactttgctcagcataaaacggccctttgattctctccgttttaagaaaaagctcatcacgacagccagggcaaataaactgagggagagactgaaaatcactgtataacccgtattattttcaagccttgagatcacgaatccggctacaatcgggccgatcattcctgcagaggaagacagaatgcccataaacccgttgaaaaagtctcgcgtatccggctctgttatttcaaaggtcagcacgttaaacgctagccaataaaagccatagcccactccgagcaccgcgccgattagcacgaggcggctggccgccgtttctccggctaaaagcacacttaaataaaaggcagctaaaaaaatgacgccgaaccttaaaataaataccctgtctatttttttggctaaccgtccagccaaataaaaggttatcggctgcattgtcacaatggataaattatatatcgccaaatcaataaatttccctgactgcttccaaagatacacattaacaaatgtattggacagtgcaattcccagcgagtaaagcccgccaatggtcagcagaaagagtaaccctttgtttacgtctacatcgcctatcactttttttagtttgctcattactgactcccctttactatcccttagtctgtctcactcaaaccgagatatgtaaaaagaagacataaaaaaacaaggccccataatgaggaccttgtttgtgccattattttgcttcgctgtatagacgagccacttcgtcccagtttacaacattccagaaagctgaaatgtaatcaggacggcggttttgatagttaaggtagtaagcatgctcccaaacgtcaagacctaagataggcgttttgccttctgaaagcggagaatcttggtttggcgtgcttgtgatttcaagtttaccgttgttcacaacaagccatgcccagccagaaccgaagcgtccagctgctgctgctgcaaattgctctttgaatttgtcaaagcttccaaatacactgttgatctcttcagcaagcgcgccagtcggttcgcctccgccgtttggagataaaagtgtccagaataatttgtggtttgcgtgtccgccgccgttgttgcggactgcagtgcggatgttttcaggaacagaatcaagatctgcaacaagctcttcaactgatttgttggcaagagcagtgtttccttcaaccgctttgtttaaatttgtaacgtatgtgttgtggtgtttcgtatggtgaatagtcatagtttccttgtcgatatgcggttctaaagcatcgtacgcataaggtaattctggaagttcgtaagccatgataattcctccttagtatatatgtactgaaatgccgcttcacagcgagcctttcttcattcaatgtaacaaaagaatgctttgtaatcaatgaaaaagctcacgatttggctcatttcagcggacatatttcactttaaccgataatctgccccattaaacctgccgccagcatttcttataggaccgtccataaaaaatatccgatcatcaaaagctgtatgatgcccttggcaataacccctgttaaaaaaccaatgagtgagccgaggccaattttaaacgctgactttaagtccttctgatggacgataagttctgcgcaaacagccccgataaacggacccaatatgatccctgcaaccggaatgacaaaaggcccgattaataaaccgatcgtgcttccccatatggcagctttgcttcctccgaacctttttactccaagcagattcgacacgtaatctgctgcgaataatactgcggcaaaaactgcctcaacaagccagaacatataagaatacggactgaatgaaaataaaaatccgtacaatacaaatccggcaacaataaatactacgctcggaataacaggatacaccagcccgataaaggcaatgataaaaaccgctgcaattaacagccaatacaacatatccatagcttccatcctcccattttactctgtcttcttcatgtcttccttgtattcacacgcatgcaacgatacaataagcaacatatattagtttagctaggaagtgaagatagtgaatgtgtttcagcttttcattaaaagtacatactctccccgtgatattgcaaaaacaagatttcaaggaatcggaaaagcgattctttatgtatttttgctctctgtcctgtttgcaatccctaccgcttattatgtaagtacagggaccgtaaaatcaatgaacggctttaaaactgttttaaacaaagatttccctgatttcacaatttcaaacggcaaacttcaaacggatgagaaaaaagccacggaatctcaagcaaatggtttcgttatcgtgttcgatccgacagactcctatggcactgaacaaattgaagcaaagcaaaacgcaatcggcatccttcagaacaaatttgttttggccattgacggacaagcccaagaaatgtcttactcaatgatgccgtcagagttacagaaaaaagatgtcattgcagggttaaaccaaaataaagcgatgattgtaactgttctctcagctcttatttttctcgtaacagcagcgggaaaatttattgaagtatcgtttttagcgcttatcgggttaatcattaagaattcgcagaaaaaacatttatcctatcatcagctctggaagctttctgcttattccatcaccctttcaactgtattctttacaatcatgcgggcattagaagcaaccgtaccaagtgaatttttgctgaactggtttgtcaattttgtcatcctgtttctcgttttaaaagagattccgtccaaaaaagctgctgtataaaccgaggctgcattcgcagtctcttttcttttgtcatgaatcgaaatggacaagcatactatggtataaaatttcgtatgcgggaggaaaagcgatgaagcgtctcaccttagtatgcagcattgtttttatactttttattcttttttatgaccttaaaattggaaccatacccattcaggacctccctgtctatgaagcatcagcaaaaacggctgtacaagaaccggcttataaaacggtgaaggtaaagccgggtgatacggttatgtcgatagtcggatcagcaggttctccggatgacattgtaaaggattttgaagcactgaatccaaatgtgaaagctaacgccattcaagccggaacagcgtataaattcccggtctacccttaatttaacgttaatttcttgtcagttcggcgaagacactgttacaatgtaatttgtaaaataaattcacataaaccatactagaattgttatatctagaagcggcaactacaattaaggagcgattgcaagtgagtgaaatcacacatcgtacaaaaacgcgtcccgtcaaagtgggacctttaacaataggcggcaacaatgaagttgtcatccaaagcatgacaacaacaaaaacacatgatgtagaagcaacggttgcggaaattaaccgtttggctgaagccggatgccaaatcgttcgggtagcatgtccggatgaacgggcggcaaacgccattgcggatattaaaaagcgcatttccattcctctcgttgttgacatacatttcgattataaacttgcgttgaaagccattgaaggcggcgcagataaaatccgaatcaaccccggcaacatcggccggcgcgaaaaagttgaagcggttgttaaagcggccaaagacaaaggcattccgatcagaatcggagtaaacgccggttcattggaaaaacgtattttagaaaaatacggttatccgactgccgatggaatggtagaaagcgcacttcatcacattaaaattcttgaggatcttgattttcacgatattattgtcagcatgaaggcctctgacgtgaaccttgcaatcgaggcttatgaaaaagcggcgaaagcgtttgactacccgcttcacctcgggatcaccgagtcaggaacgctgtttgccggcacagtaaagagcgcagcaggactcggcgccattttaagcaaaggcatcgggaacaccatgcgcatttcactaagcgcagaccctgtagaagaggtaaaagtagcaagagagcttctgaaatctttcggcttagcctccaatgccgccacgctcatctcatgtccgacttgcggccgtattgagattgatctaatcagcattgccaatgaagtggaagagtatatttctaagataaaagcgccgattaaagttgctgttctcggctgcgctgtaaacggacctggtgaagcgagagaagctgatatcggaatcgccggcgcacgcggtgaaggactgctgttccggaaagggaaaattgtccgtaaggttccagaggaaacgatggtagaagaactcaaaaaagaaattgacattcttgctgaggaacactacgcaaaacttgaagctgaaaaagcaaaattaaaagaagaaacacaaaaagcttgacgggaacccgtcaagcttttttgtgttagaaaaatggaataataaatattccaagcactaatgaaacgacaccgatacccattgcccaggctccaaggccttgagcacctcttcttcttgcgatatagccgacaataataccggcagctcccaataaaacaggcagtacaaacaatgaaatgatggacaaggctaaagcgatgtaccctattccccgtccttcattgacattgccgccgctgcgatcattgtcttggtcattgctgcggtcagcagcacgataaggctctgcgatttcagcagctgtttcctcaaaaaaaccgtcattgtcgcgggtaatatttgtcccttcagatccatgatcaacatagtaactgttgttatcacgcttttcgtaatcgtttgccaccttcaattcccccttctgttttattaaaggagcttttatagtttgatccattttgcctgattcatgtttgctaaacttttctgttaatgtcaattgtttatgttacacttgaagggatgaaactgaaggagtgtgggcatgttacgcttaggaatagatattgacggcacaatcacggctcaggatacattcgtcccttatttgaaccgttcgtttaatctttccatttcattaaacgatatgacggattatgatttaacaaagctgttaaacattacccaggaagaattttgggattggatgaatcaaaatgaagcaatcatatataaggaagcattgcttgcacagcatgcgaaacagtcacttgatcttctcaaagaggagcacaagcttatttatattacagcgagacggactcatttaactgatattacctatgaatggtttgacagacaaaacattcattatgaccacatcgaactcgttggcggtcatcacaaagttgaagcggtcaaggatcataacatcgacctgttttttgaagatcatcacgggaacgccatgatgattgcgaaagaagccgggataccggtgattttgttcaattccccttataatcagcttccgattgattcaaacatcatcagagtaaacaactggctagaagccgttcaatggatgaacaacaacaagcatcactttatacgcgtcaataactgaaaaaggagcccaaaccgggcccctttttcatatatacgcattttacgcagtagtgttgtcttggttttccgctgtacaatcagggcatgtgccgtaaatctcaaatttatgcccgctgacctgatagccatccaaatcatcacaaagcttgtccatcggacatgattcaatttcctttgttttgccgcaggcaagacaaataaaatgatggtggtgatgggtgaatgaacacttaaatctgaaaagcttttcaccggacagctcagttgtttccaaaatcccaagttcttcatataaagaaagatttctgtagattgtatcaaagcttaagcctggataatcatcattcagtgcagacagtacgtttttagcggtaagatatctgtctgaatcagcaaaaagctgcagcatatcctcccgtttgtttgtatatttatatccgttttcttttaataggttcagcgcttcttggacgttcatgaagggtccccttttcgctttgcttaagaacgtatcacatgtatgaaaaagaaaatggcagctgtctgtccagcaagccattttctttactgcagataaaattatacccataaaatgaataaaagtaaatgaaagcctagtggattgcgtttttgaattttccgcctctcgtttcatgagtattcataattgttatgaatgcattttgatcaacttcaaacacgatcgatttgagctttgtcacttccagccttgtgacaaccgcgtaaattacgtctttttcttcgtccgtatatccgcctttccccttcagcttcgttgtgccccgaccgagacggtgcaaaatcgcgtcggaaatctcatcatactgctcagacacaataatgacagcttttgtttcatcaagcccttggatcacagcatcaatcgttttcatcgcaatataataagtcatgaatgagtacatcgcttgctcaggaccgaacacaaaaactgcccaaatgaagatgaacacattgatgaacataacgaactcacctactgaaaacgggagttttttggtcagcaaaataccgagaatttctgtaccatccattgaacctccgtttcgaataacaagcccgacgccaaagccgagtaaaagacctccgaacacagtagccaaaataggctgggttgtaatggcttctacatggtgaagtgaggattcaataacggcaagcccgacaatccctataaacgtagagactagaaaggtcttaccgatatatttatatccgaagatcataaaaggaatatttaatatgacaacgaaaaaagcgaaattcagaaaggggtttgacataaagaggtggtctaaaataagtgatacaccgataatcccgccatcaataaaatcattggggattaaaaataattcgatacttacagccgcagatgcagcacctaccagaatcataaagaccctgaaaataaaatgggtaaatgtttctttcttatgttgttttgttggggtcataaaatctcctttcctgcaataactattttaaatacattataaatctattttaccattaaacactgacacattttactgatttgcccatacattaagtctggaggtggaatgaccgatgattttatttcaaagaattattttacagcggcttaatcaggctactgctgatgatttgctgaagtactcaaaacaatacggtatcagcttaacaagatcgcaggccgttgaagtagcgaacttgttatacgggaaaaatgtaaacatctttaatgagagtgaacgaatgcggctgttgaaacaagtagagacgattacatcgaaagaaacagctcaaacagttaatgaactattcaaacaatttacaagctaaaaaatgggggtgttatcccccattttttattgctgtaaaatcttttcgagcaatgtatcatcaaattgtttttctttcagcatttcaatctcaaaacggtatggcggttttttgttctttttatcttcaccgacatatggtgtttcaagaatttttggaatgtcttttaactgctcatggtgaacaacatattgcagtgcgtcaaaacctatttcaccaaagccaatattttcatggcggtcttttctcgcacctttgacatttttgctgtcattgatatgaagcactttaatacggtcaatgccaatgattttatcgaactcatttagcactccgtcaaagtcttcgacaatgttatacccggcatcatgtgtatggcacgtgtcaaagcacactgacagctgctcattgtgtgtaacgccttcgataatctgtgcaagctcctcaaagcttctgccgcattctgatccttttccagccattgtttctaatgcaatctggacattttgattcggatcaatcacttcatttaagccttcaataatttttttgatgccggcttcagctcctgcccctacatgagcgccaggatgaaggacaatttgcttcgctccgatggccgctgtccgttcaatttctgaacgaagaaaatcaacacccagctcaaaagtggacggatttgtcgtgttgccaatattaataatataaggcgcgtgtacgataatctcgtcaatgccgttttcttgcatatgtgcccggcctgcttctatatttaagtcttcaattttctttcggcgcgtattttgcggtgcgcctgtatagatcataaacgtattcgccccataagagactgcttcctggcttgcagccagaagcatatgttttccgctcatagagacgtgtgagcctattctcagcaacaggttcccctactttcttttcttagattggtttcttctctgttttttcttgattttctccatctcatagctcattttctttttatacccaggcttaaccttcttcggctttttcacgagacgatgagcaatttcatccgcttcattcggcgtttttttacgctttttgcggcgctgacggtcatcgccttttttccattcgcccttgtcaagctctaagtaatcaaattcgatgcccattttttcaagtcttactaatgcatcctcatcagtaagctcataaatggtcatcgcttgtcctgatgagccggcacgagccgttctgcccacacggtgaacatagaaatcgagatcatccggcagctcatagttgataacatggctgacacctttaatatcaatacctcttgcggcaaggtcagttgcaatgacatatgtgaattccaaatcattgatctgcttcatgacttttttccgctcacgtggtgttaatccgccgtgcagcaagccaattttcatgcctttgccagtcagatactgggcaatatggtcagccgtatttttcgtgttggcaaacacaatccccaggtatggattcagatgcgacatgatgtcaaaaaggagcttgtccttgtcacgatgtttcgaaggaatgaggatatgctcgattttcgcagcagtcacctgttttggctccacatgggcgtatttcggattttccatgtatttcttcaaaaatggtttcagcttttccggtatggtcgctgagaacacaagcatttgcagattttcaggcatgcgggaaccgatgtaatctacatctgcaaggaatcccatgtccagcattaaatccgcttcatcaataacaagagattccgctttatgaacacttaacgcctgttctttgattaagtcagcaatccgtccgggtgtaccgacaacaagatgcggctgtattttcaatttatcaattgatttttgtttatcagtgcctccgataaaacatttcgagcgaatctgactgccttcctcaccctgtgtgattttaagcgcttcctgataaatctggttggcaagctctcttgtaggagccgtaatgactacctgaacgacatccttagcaggatcgattttgtttaataaaggcagtaaataagcgtgagtctttccagtacccgtctgagactggccgatgacgctttctttttttaacactgcaggaatcagccttttttgaatatcagtcggttcgtaaaaaccaaggcgatgtactgcatctataataaatggtttcaattcataaagttcaaatttcgtttctttcatttttcccagctccttaaagcggcacattatgtgtccatcatcacattatacccgattttgcttaaaaacaccacgtttgcaaggcgtttgttttattcagttatgtaaagcaaataccgcagcccatgcatattctaatagcagagagagctgaaaggaggtacaagtatgttttcaccgcagcagccaatgagaaattacccacagcccggaccgccccgccccatgccaaatcagcgaatgatgggcagaagaccgcctaatatgcgaggaccttcatttggagcacagcagcaaggttttcagcaagccggacaatttcttcctcaggcaaatgccggagcgagaaatggtgcaggtgcaggtacaggcggaggcttaaaaggaatgctgtcaaggttcctacccggcggaggaggcgctggcagcgccggagttcctggaattccaggagcaggtgcagcagcgagcggaggtgctggcctgcaaggcattcaaaatatcgccaatcctgcatcattatccagtatgcttggaaatgtgcaaaaagtactcggcatggcgcagcaagtcacccctatgatccagcagtacggcccattagtccgcaatctgccagcaatgatgaagctgtacagccaattaagtaaaagtgatgatactgagacagagaccaatgaggaaagtgaaaaacaatcagtttcagaagaatcatcagaaaaagagaaagagactgaaacaaaaacctcagatgggaacaaaaaatcaaaaccaaaaagttcttctctcccaaagaaatctaaaacaactgacaataaagaacaagaatcaaaaacgtctgccccgaagaaaaaggaagctgcctctcctgctccgaaaagaacatcaggcagttcaaaaccgagattatatatttaacattctttgatatctgaagtgagattggctataatgagatcagaagaatgcaagaatagagccgtttgattacggctttttatattgcctttactcacttcagtattggaggacaaccgaaaatggacgtaattaaaatttcaccgcgcggctattgctatggtgttgttgatgctatggtcattgccaaaaatgcgtcactagataaaagcttgccaagacccatctatatactcggaatgattgttcataataaacacgtcactgatgcgtttgaagaggaagggatttttacattggacggctctaaccgtctggacatcttaaagcaggttgacaaaggaactgtcattttcactgcgcacggtgtttctcccgaagtcagaagaatcgcagaagaaaaagggttagtcgcaattgatgctacatgtccggatgtgacgaaaactcataatctaatcttagagatgaaagaaaaaggatatcacgtgatctatatcggcaaaaaagggcatccagagcctgagggagccgttggcgtagcgccggagatcgttcacttagttgaaacagaagaagatgtaaagaaccttgatatccaagcagagaagttaatcgtgacgaatcaaacaacaatgtctcaatgggatgttcacgacattatggagcttgtcaaagaaaaatatcctcatgtcgaatatcaccaagagatttgcctcgctactcaagtgcggcaggaagctgtatctgagcaggcaaaaaaagcggacttaacaatcgttgtcggagacccgaaaagcaacaattcaaataggcttgctcaagtgtcagaggaaatagccgggacaaaagcataccggatcggtgacttaagcgaattgaagctcgaatggctgaaaggcgttaataccgttgcagttacagcgggagcttcaacaccgacgccgatcacaaaagaagtcattcgctttttagagcagtttgatcacgaagatccatcaacttggacaactgaacataatataccgctcaaaaaaatacttccaaaagtaaaagcaaaaaactgaggctgtaaaagcctcagtttttttatagaaatgtaaatggatttgtatctgtttcagaaacaaagatattcacgccaaactttttatcattacacattgatgtcagttttctcgtgacgccttctttcatgattttttccgcgtaatggcccggatcaaccacatttaggccaagcatcatcgcatcatgggccacatggaagtataaatctcctgtgacgtaaacatcggctccctttcgttttgcatgatgaatatacttgtttccatctccgccaagaacagctacttttttcaccatgctgtcagcatcccccaccattctgacaccattgacgtcaagcttgtctttcacaaataaagcgaattccttgagcgtcatctcatttttaagggttccgacacggccgagccctttttcggcgggagtctgttcgataggatagatatcgtaagcaacttcttcatatggatggctttttatcattgcattgataacagctttttcgacgcttttaggaaatacagtctcaagccttacttcatgaacaagctcaagctctcccacttcaccgataaaaggcttagctccgtctaatggtttaaaactgccgattccttcagatgaaaacgcgcaatggctgtattcaccgatatggccggcccccgcatttccgagcgcggctctgacctgctcttcatattccttcggcacgtatactgccagctttttcagaggatccgtataagtaggcaccagcacttccgtctgactcagctctaatgcttcagcaagcaaatcattcacaccgccgtccgcaacgtctaaatttgtatgagctgcataaacagcaatatcatgcttcaaacacttttcaattaactttccggcaggctgatctgttgaaatatgctttagcggccggaaaattggtggatggtgtgcaataatcaagtcaacctctttttcaatcgcttcatcgataacgctctctaacacatcaagtgtaaccatcacatttttaattggtttgtttaaggtgccgatttgcaggccgattttatctccttcaaccgcataggctttcggggaaaattgttcaaacagctggatgatctgctgcccatttacacttttagccatgatcgattacctcctttaacagctccattcgatcggcgagctcctttaatttttgtttgttttgctctgtatccgccgcttggctgatctgttcataaatgctttgagtgtgctgaagctcttgtgtccactttttcaaaaagacagcatttttttcttttgccaagaaagggccgacaagcatcccggctgataaagaaataccgtcataagccgcatccctgtctcccgcttcggctaccagcacctcatagcactttccgtcctcttcaaggattacctcatctatcagcgcatatccttctttataaagccactccctgatatgaacagcatgaatattcggctgtaaaatgaaccgttctttccccgttaatttgtctttgcctgcttctaaaatgtgagcgatcaaagccccgcccattccggcaatcgtaatggcatcagcttcaccttttttaatcacttccagtccgtctccctgccttacagaaatgtgcgagtttaagcctgatttttcaacctgccgctttgcagacaaaaatgggccatctgtgatttctccggcaatcgccccgctggctttatgattcagcaccgcataacaaggaaggtatgcgtgatcagagccgatatcggccatcaccgctccattcggtatgtactccgctactgtttgcaatcgtttagataattttaattcgttcacttgtcatcacaacttttctcaatcattttttcctttactatcatataaaaaatcagcccggaatccaagctgaagcaaatgattttgagattatttcttttgatgcaggtctgcacgcggcagtcaaaaataaaaggctgtcgagaacatctcggcggcctgtgaatgtataaagagaaaaatggttcttttatttaattttcgacacccactctgccatatcatccagcttatcggccggaacaagaccggaaggcattccattaccgcctttttcgatctttgttttaatttcagcgacatctttcttatcccctacaccttttaagctaggacccgaaacaccttcataattttcaccgtggcatgcgatgcagtttgccttgtaaatttcttctggtgaagcgtttgcatctttcttttcagcagatttgctttctcctccgcttgcaatctcccgagagtcatcaagtccttttactgataaaaagaaagttagaccaattcctaaaacagcgatcagcaaaaatggaataagcgggttccatttcatttcccttccccctttttgatccttccccctatgtaaacacttctaattctaacttatttttacaaaaagtaaatggattgctatacaaaagttttttattcacactttatacaaaattgaattgaaacatgcctaaatctctaatatcctttttattctattgtataatgtattgtatacgcttacaatagaaaatatggaattagattttgaaatttttcaccacaatgttcatttgcaaatgacatcatttttcagtaaaataaaggcatattatccatatatctttttaaaaaagaagaacggatcatcaagacccgttccatcttattcgaggaaatctttcaaacgtttacttctgctaggatgtcttagtttccgcaacgctttggcttcgatttgtcgaatacgctctctcgttactccaaatactttgccgacctcttctaatgttcttgtacggccgtcatcaagaccgaatcgaagacgcaatacattttcttcacgatcagttaacgtatcaagcacatcttccagctgctctttcaatagctcgtatgcggcgtggtcagaaggtgaagttgcttcttggtcttcaatgaaatcaccaaggtgcgagtcatcctcttcaccgatcggtgtttccagcgataccggctcttgagcaatctttaagatttcgcgtactttttcaggcgttaaatccatatcttccgcaatttcttcaggtgttggttctctgcctaagtcttgcagtaattgacgctgcacacggattaatttattaatggtttcaaccatatgaacgggaatccggatcgttctcgcctgatcggcaatggcgcgtgtaatcgcctgtctgatccaccacgtagcatacgtactgaatttataacctttgcgataatcaaatttttcaacggctttcatcaggcccatgtttccttcctggatcagatcaaggaacagcataccgcgtccgacataccgttttgcgatactgacaacaagccgcaggttcgcttcagccaatctgcgtttagattcttcgtcaccttcttcaatcttttgagcgtaggcgatttcttcttttgcagaaagaaggttaacccgaccgatttcctttaaatacatacgaactgggtcattgattttaacgccaggcggtacacttaggtcattaaggtcaaattcttcttcggctttggcaagctgctgaatattaggatcttctgtttcttcattctcactaattaattcaacaccttgttcacctaaaaattcataatactcatccatttggtctgattcaatttcaaagctggacatacgctcagcaatttcttcatatgtcaaaacgccacgttttttaccagactctgttaattgctcttttacttggtcgaatgttaattctgtctcgtgggtttgtttatcagccattatggatccctccttccaaagcttgcaacgaattctataagcggtatgattcttattcggtccattcaggcgttttctatgtgaactgcctttaacaatgtgcgaataatgaaatgacaattcatgatgaggttaagcgatctatttgctcctccgcaaggaatcattgccaataaatgctcctcatcagttctccagttattttaaagatcggttcaatgtaacgatttcttgagccagagaagcagctcttaaaaaatctttttgcctttcggcttcggctctttccgcctctttttcttttatcattgaccaatttctttgattcaacactttttttacataatctgataactcggcttcgctaagctcttgactaacctgaagcattaatatatcagacaagagctggcttatatgatcatccgtcaccctggccatcagatgctgaggcgtcagctcggctccctcttcataaaaagcataaagataggcagctaatgcccggtgctcatcaatattaaattgaaaccctacccggtcaatcacttttttgatgacgctccgatctcgaagcatgtgagcgagtaacagcctttctgcattttcatacgccggacgcaaacgtttttgccttgcttttgtcgtcagatgcgctcgccgcgtttttgtttcatcgctattgtcagcaggtttgttttgcttgctgaaaacagacagctgctcagttaaagactcctgtgaaagcgaaaactctgaagcaagctgctttacatagacttcctgctctagagaccctgaaagcgtgctgatttctttcagtacgtctttaatgtaagctagtcggtcgccttcatcggacaggttctttccttttcggaaatattgcattttgaacgccattacggtgacactggcgtcaataatgtcgtttttaaatttttccccgccgaattttttgatgtaatcatcagggtccaatccgtcaggaatcattgcaactctgactttgcagccttttttttgcagaagctccgaagcttttaaggtggcttcataaccggctttatcagagtcatagcaaagaatgatttcttcgacgtttcttctcaggatcttgacatgatcatctgtaagcgatgttcccatcgtggctatgctttcttttacacccgagcttacggccgatatgacatcagcaaacccttcaaataagactgctctttcctgctttctgatatgaaggcgggccttataaaaattgtaaagcagtttacttttatgaaagagcggggtttcaggactgttcatatacttaggctgctggctgccaagagccctgcctgagaaagcaacaacagccccgtgatgatcatggatcggaaacatgacacggtttctgaagcggtcgaaatatccgcttccgtcttcgcgtctgatcaggagacccgctttttccatttgtgcctcactaaatcccctctttacaaggaatttcgtgataaagtcccaagaatcaagagcatagccaatctgaaattcatcaatcagctctttcgtaaagcccctagaaagcagataatccagtgcctcttgaccttcttttgtatttattaacaaatgatggtaaaatttcttcaggagctcatgtgcctcagccattttttgttctccagaagactctggccaggctccggaatggactgttatatcatctggaaaatcaatttggtatttgtcagcaaggtgagaaaccgactcggcaaatgagtagccttccatctgccttaaaaaagagaaaacattgccgcccgctccgcagccaaagcaatgaaaaatctgtttgtcgggcgatacggaaaacgaaggtgtgctttctccatgaaaaggacagagtccaaagtagtttcggccttgcttctttaattgaacataatcacctatgacttcaacgatatctgccgacttttgcacctgatccacaatttcatctggtatccgatttcccatcttataacactccgtcgtacattattcgatgctttagtgcaaaatcccttcatcgttcgacaggattttttgcagcagtgcaataaatcgttctcgatcttctttattcaattttttaggccctttggcatatacgccttttcttctttgtttgccggaaaaatgacggccctctagagcaaaatcaatcgtgtcttctttgtaaagacgacctctttccgacataacagagacatttctgttcaacagcagagatgctaatccgatgtcctgcgtcacaacaatatctcccggtttcacgtgatttgcgatatataaatcagcagcttctttatgaggatcaacatacttccatttttcttcattgcttctggaaagctgataatgttcaaatgaagcgacaaaaagaacttgaacttcatactcggatgctgtttgtaaaatttcatcttttaccggacaagcatcagcatcgacaaaaatcgtcttttcttgttcattaagaagagtaattctccatccctccattaaactcctgcataaaagcaagcaaaatcgcacatcctttattattgtggatgtatatgaatttgtcgaaaaatttccgggagaaattcttgacatcttacccataatagtttattcgtatcacacgatccttaaacctaaaattaatcattttatcacaattttttattataatacaaacttcacaaagatgctattgtttttcattattcccttttggcacagccaaaaacccaggatagagcgtcctgagttatatgttttttgttttgagatgatggataatatttgctgtttcctcaaccgctttatttgaaacatcaacaacctggcagccgatccgatccacaatcttttcgaaatactcgagttcctctttgattctgttgatatttgcataaatcgctttatcattaagcccgagtgattttaaacgttcttttctgatatgattcagtttatcagggctaatctttaaaccgatgcattttttcggatcaacgttaaagagttcttccggcggatcaacctccggaacaatcggaacattggcaaccttcaggcgtttgtgtgcgagatattgagacagcggtgttttagacgttcttgaaacgccgatcaaaacgatatcagcttttaaaatccctcttggatcacgtccatcatcgtatttaactgcaaactcgatggcctccacttttttgaaataatcttcatcaagctggcgcacccgccccggttcgtatttcgctgttaaaccgtaggctgtttccattttatcaatcaacgggccgataatatcataatataaaacatttgctttttccgcttcggctatcaaatattctctgatttccggcaccacgagtgtaaaacagataatgccgccgtctgcctttgcaagtgaaatcacttcattgatagtgcctatatcttcaacataaggaattcttcttacatgagtatcatccgccgatccgttaaattggctgagtgctgcttttactaccaattcagccgtttcaccgacggaatccgatacaacatagatgatgcggttattcatattatccccccgttagtttgcaatcttataggatttcattttcagataaactgacaagtatttttgtcatatttgtttttgtcactctgccgatcacttcaaagcctttatcggtgtctttgatgacaggcagtgcatcaatttgtttttctattaagtgctttgcaatgtccatcacataatcctcgcgtctgcacaccgtaatgttcggcatccttgtcatgatgatgtgaacagggaccgatgtaagctcctgctggccaatgctcgctctgagcaagtcttttcgtgaaagcaccccgactaaaacagcatcgcggtccaccacaaacagagtacctacatcttctaaaaacatggtgcaaatcgcatcgtacacagaaacgttttcgtgaatcactacggggatagattgaaagtctttcacctgaagctttttgagtttatccgccaaaagctgcgtgccggtttttcccgtatagaaataaccgactctcgggcgcgcctcgaggaatcctgacatggtgagtatggctaaatccgggcgcaatgtcgccctggtgaggttcagcttttctgcaatatgctcccctgtaatcggcccgttttcttttacaatctgcaaaatatgttcttgccgtttatttagttcgatcgtactcaccaccttttcacttcatagctatgtaaagaaataataatccatattataacgtaaatatcttgtaatcaaacaaaaaacttataaatggggaaaagacgattaccgatcacacagcaaccgccttttctctctttattttacaataagggcattcatattcgcaaaggacttgatctcatccgccaagcttaccatttgcgctaaacgatttgcctttaatgcctcattatccgctataaccattgtatgatcgaagtaagcatcgatcggttcttttaaggctgcaagtgaagcaagcgccgcctcataatcttttttgctgaagttttcctgcagattttgcttcgctgtttggtaggcatcaaacagttttgcttcgtattcattttcaaacagatcaggctgaatgtctccgcggactccttttttgctgatagagatcactcggcctaacgcttcggctgtttccttaaagccaggtgcaccaagcttttgttccagtacttgtgctttatgcagcgcagagtacggctcaagctcagagctttccagcacggcgtcaatgacatcatgtctgatttgttcagcattcaagacatatttcaagcgctgagtgaagaaatccagcagttcattttctttatcggtttgtacgaaagtaagcagctcttcaaatgaaattccccagttgcggtcaagaagaatcgcaacaataccgcttgcttggcggcgcagtccgtaagggtcctgggaaccggttggaattacgccgatagagaagaatgaagcgattgtgtcaagcttatccgccattgctacaacagctccggtgaaagtagaaggcgtttctccgcccgctgatctaggcatataatgttcattgactgccgccgccacagcttcatcttcgccaagcattctcgcatacttttcgcccataattccttgaagttcagggaattcatatatcatatgcgtcacaaggtcgaatttagaaatttcagcagcccgcttcacatgttttaatgtatcttcatcagcctgaagacgaacggcaagtttctctgcgattgatgtgactcttctaaccttatcagcaagagaaccaagctcttcatggaaaacgatattttcaagcttcttcacatttgcatcaatgtttagtttctgatcttccttgtagaagaatgacgcatcagataaacgtgcgcgcagcactttttcattgcctcgggccacattttcaatcgcgtggctgttgccgtttcggactgtgataaagtgaggcagcaggtcaccgtttttgtctttgacagggaagtagcgctgatgctctttcattgtcgtgacaagcacttcttcaggaattgacagaaactcggattcaaatgaaccgtaaagagctgtcgggtattctactaaatgattcacttcatcaagaaggtcttcgtcaactggaatgctccaattgttttcagcagccattgtttccagctgagattgaatcatttgctttcggacgctaggatcggcaataacatgctgttctttcagctgctcttcataagctgaaggtgattcaattgacacttcatgtccgaggaaacggtgtccctgtgttgtccgtccagactcaacgtttgtgatcgaaaatggaatgacatcctgtccaaataatgcgacaatccatttgatcggtcggatataacgcaaatcttcatttccccagcgcatgtttttcgggaaatgcaagcttgtaattaaaccgctcaattctggcagaagcgacttcgtttcttggccggcttggaatttttgcacgaatacatactctatgccttttacttctttgatatacaggtcttccacattcgcgccttggccttttgaaaagccgattgccgcttttgtccagttcccgtccgcatcaagggcaatttttttcgcaggcccttttgcttcttcttttatatcatcctgcttttctgcgacatccttaacgaacacagcaagacgtctcggtgtattgaagagtttcacttcaccgtgagtaatatttttttctttaagccagcctgtcagcttgtcgccaagctgaaccatgctttcattcaaaaagcgcgccggcatttcctctaatccgatctctaaaagtaaatcctgtttactcatgagaagaaccctccctttaagcattgggaaccctagtttttctcgttcctcataataggtttttgctacttttctagctaaattccgcactcttgcgatatagcccgtccgctcggtaacagagatcgcacctttggcgtcaagcagattgaaggtgtgcgaacatttcagcacatagtcatatgctggatgaacaagtccgttatccatttgcttgatcgcttctttttcatatgtgctgaacaattggaacagcatatcgacgtctgatgtttcaaacgtataaacggaatgttcatattcagccatcatgaataaatcttttactgtaaaccctgacgtccattccaagtcaaacacgttttctttatcttggatataagacgcgagacgttcaattccatacgtaatctctacagaaacgggtttacactctaatcccccgacctgctggaaatacgtaaattgtgttatctccattccgtcaagccaaacttcccagcctagacccgcgcagcctaaagacggattctcccagttgtcttcaacaaagcgaatatcgtgctcaagcggatcaattccaagagcacgcaaggaatctaaatacagctcttgaatgttatcaggagacggtttaataatgacctggaactgatgatgctgatacagtctgttcgggttctccccgtagcggccgtctgccggacgtctggaaggctctacataagccactttccacggctcagggccgatactgcgcaaaaatgtatacgggctcatcgtgccggctcctttttctacatcgtaagcctgcataagcacacagccctgactggaccaatgcttttgcaaggttataatcatgtcttgaatattcatttcaagcacctccacttttctttcataagttgactgcggcagcaaccaaaaaactcccgtctctatgcttgccagccgcaaacatagggacgagagttctcccgcggttccaccctagttgctgagaacaaaatcccagcctctttttttaaaattgctcaagaatgcctttcgttgcgtgctcatccttagcttacaccgccctaaggtcgctttcatgaggtaaacgcaagtacttctttctctcactgcaacatattttataataaatgatcatataaaaagatggaccaaatgtcaacttttgttttcacccataagatgtttcatgctttccatttgatctaaaaagcgctttgattttaaatacaatcccgaatattcttcgtaatataaatcaatcacttgctttaattcagcttttgtttcctcttttaaggacacattgccgagtctcgacagatcaaaatagtagaagagtcttaacagccttgccgtttgcggtttaatcggtatcctgtaaggatctttttcaaaacagcggtggcatataaaaccattatcacgaacagaaaaatgaaaggttccgtcttggcttttacaatgtacacaatgattcagctcaggatacaggcccatgacaccgagcatcttcatttgaacaatgaaggtgataacatccggatctgttccttcattcagctgttttaatgattctaatatgaattcaaataaataaggatttgactttttttcttctgtgcctctgtcgactaactcagcaatataggcagcatatgctgttaaaaacaagtcttccctgatgcctctcatgctgaggatcatttccccctgctgaagcgttccgaggcccgatgttttttgcattaagaaagaaccatacaaaaagggctggctgactgctgataaacggctgttcggttttttggcgcctcgtgccataacacctatttttccgtgttctcttgtcagtaatgttacgattttattcgtctctccgtaatcatttgtgcgaagaacgattccttcacattttgtcagcatttccgcaccttcctcaagcaggagcggccaagaggtttataaaattggataatcaaatcgggctagctcatcttctagttcttcgggtctttccatgttctctttttccagttctttaaaaagaagatacgtatcaacatttcctgtttgagaaaatacgttccaggtaaaattcaacacaagaaacccacctttctgtagttaaactagcttacctaaactccaaattcttacctttatcttgaccagatgtcctccatttcatgttaaacaaaatttgctaatgtatccctgttcctgtgagataatgacacacacagcaagagattaatattcgtcctctttaaagccaaaatcgcgaagctgggacattttattacgccagtctttctgcactttcacccacaattcaaggtagacacgggagcccaacagtgcttcaatatccgctctcgctctttttccaacctcttttagaagacttccttttttaccgatcacgatgcctttctgggaatcccgctcgaccacaatcgttgccgctacgtgcacagaaccgttgtcctgccctttgatggattcgatggccaccgcaatgctgtgcgggatttcttctctcgtcaaatgtagcaccttttccctgattaattcagaaatgataaatcgttcagggtggtcagttacctggtcactcggatagaattgcggcccttccggcaaatacgcttcaatctgagcgagcaaggtttcgatgttatttccttctaaagcagaaatcggaacaatttccttaaaaggataacgtttgcggtattcgtcaattagcagaagcaattggtcgggatgaattttatcgattttgtttacgattaagaatacaggcgtagacatcgtctgcaatttctcaatgatgaattcgtcgcccttcccgtagccttcctcagcattgatcataaacaagatcaaatcgacttcttttaatgtattttgcgccactttcatcataaagtccccaagcttatgcttaggtttatgaatccctggtgtgtcaataaaaatggtttgtgatgtgcctgtcgtcagtactccttgcaccttgtttctcgtcgtttggggcttatcgctcatgatcgcgattttttgtccaatgactctgttcaaaaatgtagattttcctacgtttggtcttccaataatggatacaaatcctgatttaaagctttcgttcgtcatgtaaatcctccgatgaaaatgcgcctggcaataattcttccacagtcatttcttttatttgtccttgtaaattagtcagtacgacaataacgtcttttgtgcaaagctcagaaatcacctggcggcaggctccgcacggagataccggtccaggggtgtcagccgcaacggccagcatctgaaactctgtatccccttcagaaacagctttaaataaagcggtacgctcggcgcaattgcacatgctgtatgccgcgttctcaatgttgcagcctctgtacacttttccatccttggtaagaagagcggctcctacttggaatttggaatacggcgcatatgccatatcacgcgcttttaaagcttctgttattaattcttgtctgttcatgtgtacattcctctcttacctataatggtaccgctatcactttatattttacataatcgcgcgctttttttcacgcccatttctaaaaatgtaaaataaatgtaagaattttcagccattacagctttggcaaaaaaataagtaaaccaatgatacacgaaatcacggcaaaaacgcaaacagccccggcggcagcgtccttggccgctttagcaagagggtgatgtttgtcagttattaaatcaaccgtatgttcaatggctgtatttaaaagctcaagcgaaaacataccgcctatcaaaaggaatataatcatccactcaatcatgctgagctctacaaggaagccgcaaatgagaacagcgcaggcggctgcggcatgaaattggaaattccgctccgtccgcgctgtttcccagatgccccggcctgcatgcacgaagcttttgaagaatcgcttcagctcatttctatgatcttttgagtccataagcgtccagcaattccttttgcttagtaaacatctcctcttcttcctctttcgtcatatggtcatatcctaaaaggtgcagaaatccgtgtacagctagaaatccgagctctcttttaaaagaatgattatactcctctgcctgctctcttgtgcgatcggcactgatgataatatcacctaaaaccggaggcatttcggcgcccacgatttcgacctcgccttctccctcttcttcaagagcaaatgagatgacatctgtcggagcatcctttccccggtattctttgttaatctgatgtatgtcatcattggaaacaatcgtgacagaaacttcagcctgatcctgaacgccttcacgctcagcggcaaattgaagcagattttctacttctttgagcatctcttctgagacgcttcctgtttcatcaacgatatcaatcagtaaactcatctatttcaccttcttagtagcctccggatattcaatccgggagtggaaaattccttttaatgttgcacagagtgtttttgcgattgtatccagctctttaaatgtcaaatcgcattcactgaactgtccgtcctgaagcttatcggatataataccccggacaagcttttcaattcgttcaggatttggattatgcatggatctgacggccgcttcaacactgtcggccactgatataattgcggcttcctttgattgcggcttcggccccggataacggaactcttcctctgtaatctggtcgcctttttcctttgctttatagtaaaaaaactttaaaagcgaggttccatgatgctgctcagcaatatcgacaagctctttcggaaatttatagctcctcagcatattcgcaccgtctgtcgtatgcgagatgataatatttttactcaactgaggtgacagcttgtcatgcggattgtcaatattcatttggttttcaataaaatattgcggtcgctttgtttttccgagatcgtgataatatgcgccgactcttgcaagcaaaccattagccccaaccgcttcacaggctgcctctgataaattggcaaccattacactgtgatgatatgtacctggtgtttctgtcagtattttgcgcaatagcggatggttaggattagacagctcgagcagcctcatggtggataaaatgccaaagcccgtctcaaaaaacggcatcaggccgatgattaatacagatgaagcaaaccccgacacaacccccatgagcattaacgtgccgatttcaagacccgacagcgcagtgttctggatcaataataaggatagaacgacaaccatattaataaacgccacgaaaagtccggtctgcaaaatctttgatcttgcattgtgttttcctaaaaataatacacctgaaatgccgctgatcaaataataaatccctatgacataattgaatgttcctgtcacaccctgattaaacatcatacttccgcaaatcgcaagaatgatacttcccaaaatggcaatgcgttcattcatcagcagtttgattaagatggcgccggccgcaatggggaccagatagccgatattattatactccatcttctgaaacaaactgacaacctccatgatcacaagcaaaagtgttgtgattatggagaataacagaatggattggtttttaaacttcagattttgtttctgtttttcaaaataatatacaagtgttgcaatgaaaagtccgatcataatcaatagcccgctgatcggtttaaagagatttgagttatttaataacccagtcagctcaagtttcctgtacacttcccgatcaatgaggtcattttcttccacaagcacttgtccctgtttgatttgaacctgctggacattgtctgaagcttcctgccgttttgcctctgttgctttcggatcaaagacgtaattcggaataatagcaaaacgcccgatttctgtcgcagctcccaagtatttagacggaatagaattgctctttagctctttttctaccttatcctttgcatcagatagtttatccgaagggatttcactgctcatgaccgtatttactgcggtaatgaccgtatctctgacaaaagaaaagtcttcactgtctgctttcagcaatgtcttaattgagccctcggatatggaatcattcacatctgatgtcaatttgtcctttacggatttgaccattgatttttccgatggtgatttgctgccttcttccgatgattttttcacttcactgatactgtcgaatattgatgacacaaggtcaatccgattatctgtgtattctttttttaatgtatattgatcctcaaccgcgtcctcagcggcttgctttttttcctctgtggctttttgatcttccacggttgccggagcataaatggtcttgtcgctgactgaaaacaggtctaaatcaagtgtttccggcttaacatgtacaaagagcaaagcaaacataatggcagccagcagaagatacagcagtacatgcatggagcgggcatttttaaaactgctccatttttttgagctgcttttggtcttagccttctttttcaacacaagaacctcctcttgaaacatcaagcccataagcaatcataaaaatgacccgataacgcgcgatcgggtcattcagcattaattttgcttatcgtatgcttcaataattttcgcaacaagcggatgtctgaccacgtctgtctggtctagctcaatcatagaaatgccgtctattcctttcagcatctccttcgctactgcaagtcccgatttgacgcctttcggcagatcaatttggctaacgtcacctgtaatgatcattttagagccaaaacccagtctcgtcaaaaacattttcatttgagcaggcgtggtattctgtgcttcatcaagtataacataagcatcatcgagcgtccgtcccctcatatatgcgagcggagcaatttcaatgatgcctctttccatcaaacgttctgtatgatctgccccaagcacatcatggagagcgtcatacagcgggcgtaaataaggatctactttttcttttaggtcacctgggagaaaaccaaggctttcaccggcttccacggcaggtcttgttaaaatgatttttttgatatgtccgttctttaaagcatggactgcttttacgacagccaggtacgttttcccggttcccgccggaccaatgccgaatacaaggtcattccgcttcatagcggccacgtattcccgctgtcccattgtttttacacggattgatttgccttttgcgttttttgtaatttcttcttcatacatgctttcaaagtattcaagttcattcttctttgccattttgatggcgtaaatcacatcacgttcagagatctctatccccttgcgaattaaagcgaggagtgatcccagcagcctgtctgcaatctgaaacgattcatcatcgcctgaaacataaatcgtctcgccgcgcgtaatgatatttacattcagatctttctccatcaatttcaaaaaagaatcttggttcccgaagagtgaaagcgcctcgtccgggtttttcagtttttgattcatcgcaagtaaatgttctgtcattcttcagtctccctgacaataggtgtggtttgaacgatatcttctataacttggtagagaataatcaactttactttaccattctcaacagtctggtgcaaaactttttcacttttcacctcgccgttttcgcctattttatcctctacatcctgtttacccaatttaatgccttcttgaactgcttcttctttcgtatattttcgtaaagcctcttcactttctctcgtttgctctttgacataggatacagggagcttaaatccgagaaaatgaagcgaatgcttttcttgttctgtttttggatgcttcaattcctcttttttaaacgtcatcccccagatcgggattgccaacgagccaaaagaaagcttgtgctttgtccttactttgcccgtatagacgttaaataatgtttcaagcgggactgtcacttctgatctataccaggtttctccgtaaatttctgcttttgaggcgacttcctgctgatggtcttcgctgccgatcagccccgaaacaagcagctgacccttttcaacatgatcgtggatggcagccatgggctgtcctttttgcacaaacattctcgtgatggttgctttctttttggcgacaatattgcgcgggctaacatacttttctttttcgggctcatttttctccacaactttcatgtgaatggtcgtccctttcagatcaactccgacccaagtgatattgtctattccattggttaatgatttctgtattttttcgggcgacatcattaaaaactgcagacggccctttttgacgccgatttcattaagatgctgcctcatttgatgttctgtttcaggcttagcgcctgtcacatcaattttccacaccatattggacagcaaaaacaaaaggatgaaaaaaatcgcaaaaccgatcgtaaaccctatattcagctttgatttcagcaacaggaagggaaaacccttccgattgataaatcgggctttacatttaaatttacttctcacccgccgaaaggcatgtacatcctgaagctgtatatataacgatacggcttctttcttttttttgacatgaaagaccggaatcccctgtcttgtgcattcattaaggagccgctcaatccctcttcccgtcaattcaagctggaccttacccgaaaaaaaagacagccatttatttttcacaacatttccccctcggctttatgactcaacatatcgaacgacatcaatcgtaccctccaaaagtatctcttccggaagaatcgccttgatgacaaaatttttaccagatatgatgcactggccctgcttcagcatcagcctcacttcattctcactgaaaagcaaaagacctctgtggttttctatgtagatatgaagtctgccaaccattgtaatcctcggcagatccatcataacgtccgggggaatttccaatgctcttgtcagccaagctttcatacgattctttctttgccccatacaaaaagaaccccctttcatctcatatgtatgatttgaaaggaggttctaacactttaatttttacgggccggcgcatcgtacggtgaggttttttcgcccgtggaggcccgaacacctctcctagaacgatcccctgtacgacggtgtctttattcacctgaagcattttttgttttgtgtatactgttttttgtttggcagcagcaagatctcgttccagccctttcaggtttcttgctgtttccctgcgtctttcttccgcttcccgtcttgcctgttccatacggttagagataggtgcaggggcatcttcttttgactgcttcttttgaggagaagcagattgcacgtgttgaggtttttttcttttttggctgttttgcttttcttctttgctctttttgccgaaaatcgcagaaatgattccgatgatcgctgcaataataagcggattggtcagtaaatcttccatcagcgttctcccttcttagagagattatgatttgcggtcttcatccgaagggtctttcgtcagcttcccgaatgaatcacgcatttctgtgtcagcatcgatgttcttgatattcatgtaatccatgacgccaatattcccttcacgcaaagcttctgccatcgcaagcggcacttccgcctcggcttctaccactttcgcgcgcatttcttctacgcgggcacgcatttcctgttcttgagcgacagccatcgcacgtcgttcttccgcttttgcctgcgcgatgtttttatcagcctcagcctgatcggtttgtaaaattgcaccgatgtttttgccgatatctacatctgcaatatcaattgagagaatttcaaacgcagttcctgagtccaatccttttccaaggactgtctgagaaatcatgtcagggttttcaagcacttttttatgattgccagatgaaccgattgtagaaacgatcccctcacctacacgagctacaatggtttcttctcctgctcccccgacgaggcgctcgatattcgctcttactgtgattctcgctttcgctttcacttcaatcccgtccattgcgacaccggcaatgaacggtgtttcaatcaccttaggattaacgctcatttgaacagcttccaacacgtcccggcctgcaagatcaatggcagcacagcgctcgaatgtgagttcaatgttagctcgctgagcggcgataagcgcgttgacgactctgtcaacattacctccggccaggtagtggctttcaagctggtttgttccaacattaagtcccgctttatgggctttaatcagcgggttaacaacccgattcggaatgacacggcgaagcctcatcccaactagagtgaaaatgctgattttcactccggctgccaaagctgaaatccaaagcattacaggcacaaatgtaaaaaatactgccaaaacaatgatcgctactgcgacaattgccagaatcataagtgttgacggatccatataacttctcctcgtttctatttaaatttctctcacgacaatgcgtgagccttctacttttatcacttttacttttttatctttttctgtaaacgatccctccgatacaacgtcaaggcgttcatcatcaataatgacggtaccggaaggacgcagcggtgtaaaggttatacccacttttcccattaagtccgtgcgcgtttgatttgaaacgtagccgctctccgtatttgtagaatcatttaatatcaatttcttaaagaatttcatacgctttcccaacacccttgtcagtaaaataaaagctgtaatcgaaacagctgaggcgatcaagagagaaaccgccattacagtgaagctccccgcggctaaaaacaggctcgcaataatcgctcccaagcccagtaatccaatgattcctccgggaagaaaaatctcaagcaggatgaggatcacccctgctataaagaggagaaccgtctcatacccggcaaggccggctgcaagatgcccgtaaaagaacagcaataacgcaatgagtccagccgttccagggaggccgacacccggggaaaaaagctccaccgtcagacctaaaaatgcgattgtcagcagaatagggacaatgaccggattcgtcagccatcttgccgtcttttccgcaaagctctcctttgcgtagctgatctgcgctttttcgaacccaagcttctttacgagcgtggacaaattgtcagcagtgccttctgaatagcctacctcaattgccttgtctgcgttaagtgtcagcagatctcccttaggcgcgccgacttccttagcatctatatctgggtcagccattgcgagcgcatattttggatcgcggttatttttcactgcgacatcttccatctctgccagccaaagtgattgagctttttggtcagcggcattgccttggccatcaacaatcgcggcggctcccatttttccgccaggcgccatataaatgtgatctgcttgcagtgcaatatatgcaccagcagacaacgcgcgtttgttgacatatgcagttacggggatctcgctttcggttatcaaatcggccatatcaatagcagatttgaccaatcccccggggtattgatatcaagaataatatggtctgcatgtgcatcctttgcgtcttgtaacgaacgggacaaaaacgaagcgagaccctgttcgacatttttttcaaccggaatcacataaacagtttgtttttctgcttttgcattcagttgtacgcctaataaagaaagcaaaaatatactcaaaagagcagcacggaatcctttgatttgaagcaagggcggtgtatccctccttccttttataataagtgccttctcttcatacgtaacaaatgtatcaaaggtttcatttttttatgtataaaaaaagacatctctcttagaaagatgtccttttctttgccatttaagacagttgactgctcacaagcttattaattaaacttccgtcagctttaccttttactttaggcataattgcccccatcactttgcccatgtccgcttttgagctcgcaccgacctccgcgatggtttcatttacgattgtacgcagctcttcttctgacagctgctcaggtaaataaacttctaaaatgtccagctctttttgaactttatctactaaatctaaacgattagcgtttgaaaattcctggagggagtctttacgttgcttaagttcacgagaaaggacagtgagttcctcatcctcggtcaaactgtctttcttaagcttaattgcttcattttgaagtgaagccttaaccattcgaacgacagtcagtttgtctttctcacggtttttcatatacagcttcatatcctggttgagacgctcaagaagactcataaatccaccctcttttagaatttgcgttttctagcagcttcagactttttcttgcgctttacgctaggtttttcataaaattcacgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaagttacacatataaacatgtactttgacattataatataagccatcagtcaggtcaactaagtgagttcacttttccgtcatgagtgcgactgcctgtctatataatgatagaaaggggttggtgaataggatgttaattctgattagctttactgctcttatattattctttctcgcaggcatgaacatgcttcgaaaaggcttaatttctatggcgtactcaaaaattgaagaacgtttgcttttatttacggaccatccgttaaaagcgtttcttatcagcattgtatttacgggaatacttcagagcagttcagcttttatggtcattgtcatcggctttgtaagtgcgggcgttctttcttttaagcggacgataccaatgattctggggacgaatgttggctctacttttacaactgaatttattgctatcaaaatggatattttgatttgggttcttttaataggaggtttattgttttttctgactggcaggtatcctttgaaacagctgggaacaagcttccttggactgggaatcatcttcttttgcatcagcggattcagccatcttgccgggccgctgacaaagctgaaaacgggagccgacgttctataccatgttaacgattcaaactggtccgctttgctcatcgggatggtgttaactgccatcattcactccagttctgtctgtatcggcattttgatgagttttatgaatgaagggattatcggactgacacaggcgatgagcgtcgtactcggatcaaatatcgggacatgcattacagctgtcatggctgctgtatccgggggtatgcggcgaaacagacagcgtatgcgcatgtggtatttaacgtgctaggggtggctctagtattgccttttctgaccgcagcgaccggctttgtagagcagttatcacccgatcccgcccaaaggattgctcatttcagtcttttatttaatgtagtaacagctcttttatttcttccgctaacaaacttgttttaccgattgattcaccttcttatcccggctaaataaaaaaccggtacattttaatgcaccgattttttaggttaagaagacaaacgcatgtgttcagttatttcatcctcaaccacacggacaaactgtccttcgttgtaaggataacctgcttttaggattttgacttttacgattttgccgatcatatcttccgtacctttgaaaacaaccttcatataattgtctgtgtaaccgacaaacatattttcttcttctgtttccttaaacgcttcctcagggataatctcaagcacttcattttcatactgagaagcgtattcttttgcaagctggtcagaaagagcaatcaggcggtgcacacgttcgtttttcacgttttcatccacttggtcttccattcgcgcagctggtgttcctgtacgtttactgtaagggaaaacatgcagttcagagaatttatgttctttaataaagttataggtttccataaattcttcttctgtttctccagggaacccgacgatgacatcagaagtaacagctaagcctggcagtgcttttttcaatttatttaaacggtctgcaaagaattccattgtatatttgcgtctcatccgtttaagcactgtgtttgatccggattggataggaatatgcagatgattcactatcttatctgagcggtctaagacctcgatcacttcgtcagtgatttggctggcttcgattgaagaaattctgatccgtttcacgccttccacacgggtgtctaattcgctcaaaagcttcgcgaagttgtaatctttcatatcttcgccgtagccgcctgtatgaatacccgtaagaacaatttccttatatccggcatcgacaagctgctgcgcttgtttaatgacttcttcagggtcgcgggagcggagcaggccgcgcgcccacggaatgatacagaatgtgcagaaattattgcacccctcctgtattttcaatgacgctcttgtgcggtccgtgaaagcaggcacatcaagctcttcatatactcttgctttcatgatgttgctgacgccattaatcggctggcgttcttctcggtattggtcaatgtagccaagcattttttcacggtcctgtgttccgactacaatgtcgacaccagggatcgccataatctcagcaggtgaggtttgcgcgtagcagcctgtgacacagatgacaccgtcaggattttgacgaatggcgcgtctgatcacttggcggctttttttatctcccgtatttgtaaccgtacatgtattaatgacatatacatcagctgtttgttcaaagtctcttctttcatagcccgcttctttgaaaagctgccagattgcttctgtttcataatggttgactttacagccaagcgtatggaaagcaacagttgccattactgatcacctcttaataactctgtttgataagaaatcgcgctcaacgcgtatagcggagcggtttctgtccttaaaattctcggtccaaggccgcacggcacaccgtcttgctctgtgagccgttcaacctccgcttctgttaaaccgccttcgggaccaaatacgatcaatagagatgatcctttcggaaggctgcttacaatcgcgctgaatgcgcttatttccccttgcttcgatgactcctcgtatgcaacgacacatttatcgaaatcctgcatcctttgaagaagctgctgaaaagaatggacatccatcactcgcggcacttcgttacggtacgattgttcagccgcttccttcgcaattttcgtccatctttcccgctttttctttgcctttttgtcatccagcttgacaacagaacgcgcggcttggaaaggaataaaggcatgagctccgagctcagtccccttttggataatccattcaagcttatctcctttcggaaggccgctcgcaatatagacctttatcggaagctctctgttttcattcgtccattctatcacaaggcaggacactttatctttggaaacagattgaagttcacattttgcctcgaagccgtcttgagagcagcagataatctgatctccctcattcattctcatcacgttcacaatatgatgaacatcttcgccggtaatcgaaaaagccggcgcttcctctatttgctgcttcgtgagctcgataaaatatcgttgcatacgctgtgacacctactaactgttatttttttgcaataatactgacccaatcttccattgaaaggatttctacaatggtaaagccagcttgttccagtgcttcttttacttcttgttttttatgaccgatgattcctgacgtaataaagtggccgccttcttttaacaggctgtacgcttgtgaagtaaagcgaagaatgacttcagccaaaatgttggccacaatcacatcatgttccccttcaatcccgtctaacaaattgttttgcttcacttgagcaatatcgctgactttgttcagcttgagattaaggcgtgcactttctacagccacgggatcaagatcataggcatgaaccgattcagcctcaagcattgcagccgcaatacttaaaattcccgaaccagtgccgacatcaatcaccttatcacccttttgcacaaagcgttcaagcgcctgaatgcagagtacggttgtgggatgtgtccctgtgccgaaagccattcccgggtccatttcaataatcagttcatcagtatggaccggcgtatattcctcccacgtcggcacaattgtaaacttttcagaaattttcacaggatgataatattttttccaggcagtcgcccactcttcttcatttacttcagaaatagtgatgtggtttctgcccaaatcaatattgtaaagaaggagattattaatcgtttctttaatgccgtctacagtttcgcccagaaaactgttaaccggcagatatgctttgacaatgacaccctcatctgggtaatcattggggtcgagctggtagatttccccgtacacattctcacgttctttaattaaatcaagcgggtcctctatcacaaccccacttgcaccagcttcatgcaatatatttgagataggttcgaccgcttcatgtgttgtgtgaatgcttaattcggaccatttcaaaactaccaactcctcatccaataattaatcgcctttaaacgcgcgttttaccttgtcaaagaaactcatttcctgttcgtcaggcaggtttccgctgacttcggcaaattcgcggataatgtctttttgtttatcagtcagatttgtcggcgtaacgacgcggacgacgatatgctggtcaccctgtccatagcctctgacattttgaacgcctttgcctcttaatctgaatttcgttcctgtttgtgtaccggccggaattttcaatttcacttttccatgcagcgtcggcacttctacctcatctccaagagcagcctgagcaaacgttaacggcatttcacagtaaatatcatcgccgtcacgctcgaagaactcgtgtgcgcgtacatggaacacgacaaataaatccccggcagggccgccgtttattcctggttcaccctgtcccgagagacgaagctgctgcccgtcatctacaccggctggaattgtcacgttgattttcttgcgttttttgatttttcctttgccgccgcagtccgcacatttgtttttaatgattttgcctgttccttcacagtggtggcagacccgtctgttaacgacttttccaaacggtgtattttgctccacgtttaactggccggagcctccgcagtgggagcatgtttctggatttgttccaggtttcgcacctgagcctttacatgtttcgcacgtttcctcgcggggaatttcgatggttgtttctttaccgaaagccgcatcctcaaacgacagggtcatcgtatactgtaaatcagcaccctggcgcggagcatttggatctctccgtcttgtgcctccgccgaaaatacttgagaaaatatcatcgaaaccaaaaccgccgaaatcgccgccgccaaaacctccgccgccgaagccttggttagggtcagtgtgaccaaattgatcgtaatgcgcacgtttttggtcatctgacagcgtttcgtacgcttcttttacctctttaaatttttcatctgatccggcttctttgttaatatcaggatgatatttttttgacagcttccgataagcttttttaatttcatcctttgaagcgctcttacttactcccagcacttcatagtaatcacgcttactcatctcgcttcactctcccgaatttctcacaataaattagattgtatcattttgaattatgatttttcaattccttttatcccgggcaagaaaaaaagtcaaagccaagagatgcctgactttgactttctaatcattgaatcagattatgaaatgtgttcttttcggtcagctccggaagcggggctgacactaaaaagaacttattttttgttttggtcgtcgtttacttcttcgtattcagcgtcgacaacgttgtcatccgctttgccttcagcgtttgctccgccttgagcttgctgtgctttagcagcttcttcataaagcttcatagaaagctcttgaacgattgtttgaagctcatcttttttcgctttgatctcttcaaattcgtttttctcaatcgctgcttttaaagcgtctttggcatcgttggcttttttcacttgttcttcatccactttgccttcaagatcttttaatgttttctcagtttggaaaacaagctgatctgcttcgttgcggacttcgatttcttcttttttcttcgcatcagcgtcagcattttcttccgcttcttttaccatgcgttcgatctcttcatctgagagacctgaagaagatttgattgtaatgttttgttcttttcctgtgcctaagtcttttgctcttacgtttacgataccgtttttgtcaatatcgaaagaaacttcgatttgaggcacgccgcgcggtgctggcgggatatcagtaagctggaagcggccgagtgttttgttgtcggcagacattgggcgctcaccttgaagaacatggatatcaacagctgtttggttatcagcagcagttgagaacacttgagatttgcttgttgggatcgtcgtgttgcggtcgatcagttttgtaaacacgccgcccattgtttcgataccgagagaaagcggtgtaacgtcaagcagaacaacatcttttacgtcacctgtgataacgccgccctgaatcgcagcacctagcgctacaacttcatccgggtttacgcctttatgcgcttcttttccagtttcttttttgattgcttcttgtacggcagggatacgagttgatccgccgacaaggatgactttgtcgatttcgcttgcagaaagtcctgcatcttgaagcgcttgacggacaggacccattgtgcgctctactaaatgagaagaaagctcttcgaatttagcacgagttaatgtaagttcaaggtgaagcggtcctgcttctccagctgtgataaacggtaaagaaatttgcgtagaagatacgccggaaagatcttttttcgctttttcagctgcgtctttcaaacgctgaagcgccattttgtcttttgataaatcaatgccgttttcttttttgaattcagacacaagatgatcgatgataacttggtcaaaatcgtccccgcccagacggttgtcgccggcagttgaacgaacttcgaatacaccgtcgccaagctcaaggatggaaacgtcgaatgtaccgccgccaaggtcgtatactaggatcgtttgatcttcatctgttttatcaagtccgtatgcaagcgctgctgcagtcggctcgttgatgatacgttctacttcaagacctgcaattttaccagcgtcttttgttgcttgacgctcagcatcgttaaagtatgcaggaactgtgataactgcttttgatactgtttcgccaagatagctttcagcgtatgatttaaggtgttgaaggatgatagcagacacttcttgcggagtgtaatcctttccttcaatttcaactttataatcagtacccatatgacgtttgactgacataattgtgttagggtttgtaatagattggcgtttagccacttcccctacttgacgttcgccgtttttaaacgcaacaactgatggcgttgtgcggtttccttcagcgttagcaataactttaggctcgccgccttcaagcactgccacacatgagtttgttgttcctaagtcgattccgataactttactcacttgaataacctcctgctatgtaattattgattcactttgaccatggaagggcgaatgacgcgatccttcagcttatagcctttttgcatttcctcaacaacaatgttggagccgtagttttcgtcttcagcctgcataacagcttggtgcagattaggatcaaattcctgccctacagcttcgatggcttcgacgccttcttttttcaaggcttctacgagctgacggtggaccatttccattccctggagcaaacttttcgtctgttcattgtcggcttcaacctgaagcgctcgttcaaagctgtcaagagccggcagcaaatcagtcacgatattttgagaacggtatttttgggacgcttccatctctaaacggctgcgtcgtttatagttttcaaagtctgcttgaacacgcaaaagtttgttttctttttcctcaagcaaaccttgcaattcgttaatttggttttgaagaagttcgctttcatttgtttcttcctgctgttcatcagcggcagcttgttcttcaatgatttcttgctcttctgtttcgttttgttcaacggtttgtttttcttctgacattgtgttcacctccctcaaagtgtaaggagaaggacaggtgctgcccttcgataaaatttgccaaaattcccttattcatcatacagacttgttaatgcttttgacaagtccgaagtcacatgctgaagcaggctgacaaccctggaataattcatgcgggtcgggccgataatcgcaattgagccgatctgcttctggtctacggaataagaagccgtaatcagactgcaattttccatctcttcatagtcgttttcttttccgattttaatcgaaattcccgtgtgcggggattgaaccagctttaaaacatcctgttctttctcaattaatgaaaggagcgaccgaactcgggtgatatcatggaactcaggctggttcagcatattgattttcccgccaaaaaacaacttttcaacgtgatttgtggaatgaaaggttgaacgaagcgcgtcgagtatattgtcatagtttttaatgtgctgtcttaggtacatgacaacttctttaaatatgcgctcattcagttcatccattggaacgccgcttaaacggtcgttcagtatatttaccagtttttcaatatcagacagatccattttggtcggaaagttaatcgttttgttttccacatgccccgtattggtaacgagaatcgctaccgccatatcaggctgaatcggaatgatttgaatctgtttaaggtaattctcactcagcttcggcccgagtacgatggatgtgtaattcgtcagatcggacaaaatttgcgctgatttttgaactgtcttctccagctcgaaaattttctctttgaagatcgagtggatttggtccaggtcgcttttcgtcagtttgacgggtgacagcaaatggtcaacatagtaccgataccctttttctgacggaacacgtcctgaggatgaatgggttttttcaataaagcccaattcctccaagtcagccatctcgtttcttattgttgcagagctaaatgtgatttcatcttttttcgaaagagttcttgatcccaccggctgtgccgatttaataaaatcgttgattataacctgaaggatcagcagctgacgatttgttaacatcatcatcacctctgttagcactctcaataagcgagtgctaattctataacaaaagtatcaaaccacaagaaaaatgtcaattataactcacccaaaaaagcgccaaaaacttcattgcctaataatttcccttgatgagtcaaataaacggcagactccgaattgtgaatcagccctttttcagcgaggtcttttaacacgcttgggaaaagtccatccagggaacggccgtatttttctgcgaatcgttttttgctgacaccggctgtttttctcaaacctaaaaacatttcttcctcaatctgttcttctgttgtcacttcatgtgtatctctgtacggaaaacccttttcagctatcaggtcaatgtaatgcttaacaggtccgacgttcactgttcgtgtgccgccgatatatccgtgagcgccagctccgaaaccgaaatattgttcgttgctccaatacgttagattgtgcttagattccatgcctgccttagcaaagttgctgatttcatattgatggatgccgtgagcttccatctggctcatcaccatttcatacatttcagcttcctgctcctgcggcggaagatgaagccgccctttttgcatcaaattataaaataccgttttcggttctacaataagggagtaaacggaataatgctcggcatccaatgataaagcagtgtttatggaatgttccagatgcttgagggtttgccccggaagcccgaacatgagatcaagactgatattctcaaaaccgatttcccgcgctctttcaaaagaggtgaatacatctttttgcttgtgcactcggccgattttttctaacagatcgtcttcgaacgtttgcacaccaaagctgaggcgatttacgcctgcttcttttaatatttttaatttccctgcggacaagtcgtccggattcgcttcaaccgcaaattccgataagtcgcttgagggcttcagtacgcggttgatcatgtccatcagctttttaagctgttcctcagacagggaggtcggcgtgcctcctccgataaagattgttttgagatcaggctgcccagtttttgctattgtatttatcatttcctgttcgagtgcgtttaaatactcgtcgactggctgactttgaataaaatatttattgaaatcgcagtagtggcaaatatgctcacaaaatgggatatggatataagctgatttcaacggattcaccttctttacagaaagaagccgcagtacaagactgcggcggcttctattgttttttcggactgtcgtccattttcagaactgccataaatgcttcttgcggcacttcaactgagccgacctgcttcatacggcgttttccttctttttgtttttcaagaagtttccgtttacgcgagatgtcccctccgtaacatttagccaatacgtttttacgcattgcttttatggtggagcgggccacgattttctggccgattgcggcttgtaccggaacttcaaactgctggcgcggaatgagttctttcagtttttcaacgatcacttttccgcgttcatatgcgtaatctcgatgcacgataaaggaaagggcatcgattttttcaccattcagcataatgtccattttcacaagcttggacggtttgtagccgatcagttcataatcaaaggacgcatagcctttagtgcttgatttcagctggtcaaaaaactcatatacgatttccgctaatggcatatcataaatgatgctgacacggtttgcgtctaaatactgcatatcaatgaaattgcctcgttttccttggcaaagctccattacagcgccgacatagtcattcggcaccatcatcgtcgcttttacgtatggctcctcaactcgttcgatcttttgaggatccggcatgttagacgggttgtcgacaacgaccttttcgccgtctgtcatgtacacgtcatagataacgcttggcgctgtagtaatcaggtcgatgttgaactcacgctcaattcgctcctgaatgatctccatgtgaagcatgcctaaaaatccgcagcggaacccgaatccaagcgcttgcgaagtttccgcttcatattgaagggaggaatcattcagctcaagcttttcaagagcttcccttaaatcattatacttcgctgtatcaatcggatacaaaccacagtacaccatcgggtttagcttgcggtatcccggcagcgcttcttctgcaggattggcagcgctcgttattgtatcaccgacacgtgtgtcaccgacatttttgattgaggcagtcaggaagcctacatcaccgaccgtcagttcatttgtcggagttgctttcggcgtgaacacgcccacctctgttacttcgaattctttgccggttgccatcattttgattttttgtcccggctttaccgttccttcaacgactctgatataagccacgacaccgcggtaggcgtcataaagcgagtcgaagatcagcgctttgagcggcgcctccggatctccggtcggagctggcaccttttctacgatttgttctaaaatctcctcaatcccgataccggcttttgctgaagcaagcacggcttctgatgcatcaaggccgataacgtcttctacctcttggcgcacacgttcaggctcggcgctcggaaggtcgattttattgatgaccggaaggatttcaagatcgttgtcaagcgctaagtagacattggcgagcgtctgcgcttcaatcccctgggctgcatccacgacaagaatcgctccctcgcaggcagcaaggcttcgggatacttcatatgtgaagtcgacgtgtcccggcgtatcgattagatgaaagatatattcttctccgtcttttgctttatatttaagctgaacagagtttaatttaatggttatgccccgctcacgttcaagatccatagaatcgagcaattgttctttcatttctcgttgagtgattgccgacgttttttctaaaatacgatccgctaaggtcgattttccgtggtcaatatgggcaatgatagagaaattccgtattctcgattgcctctctaaacgcttttctttatctgtcacaatctatcactcctactattaaacgcaaaatacactagcttagattatatcaataggattgtaaagattcaatgtaaaacaagaaagagaaaagttccctatcatatctgggctgcttttctctttcacgtacttattgattcatatcccgtatccattcatacattgactgggcagtattggttacggtgttcgaaagcgcttttccggcttttgaaaacatattgaatgtctccaccttttccagctctttttgtttttcttctaaatcttttgccgtgactgtttctcctaggattgaggcttctttttcattatcttttccgtcggtgagcgtaaacgcccccttcagtgaagggtcatgatagcctttcatactcagcatcccgttgtttgcctgctgcatgccgaacagtacgcctaaaaacatgatcgtgataagcagtaagcattttccaaagtatgcaatcaaatcaaccacctatttcttattgttttttcgtctccccgctcgctgcgttgaccttttcagcatcccagtacatttcgctgaatacgtccgcggccgcgttagccgcacgctgcagctcttcgagattattatctactccgccaaattcgagcaaaagcgctctatcggttaaatcctgattgtaaacaccattatcgcctggcgagcctttggaaaagacacctgtgctaagtccggggtattttttctccatcagtttatgaagctcactcgcaattttatagttttcttcgaagtttttgctttttttcccgacgacaaaggctaccctggcatagctttttcctttaatcgttgcggttgtgtcttttttgcgccgtgagtctctgtggatgtcaatgatatattgcagatttttgtttgaagcgagggcgtctttcacaaccggccttgattcatcataggacctggcatagtttaagccttttttattcaattttgactgtatatcggttttattcactgtggctccgattccctgggattcaagcgcttgtccgaacatatctcctacaagcgtgacgttggctttagaatggcgcgccatgtcaggatcggtctcaccttttaatagagggagatatgattccgtattgtgcgtgtgatagataaacacaacctttttatcacctgttgtttgtttgggcggatctttttgcgcattatctgattgcgtttgctgtttttcaatctctgccaaattcgcttccctttcttcctccatcaccttagacggcggcggcgattccgcaggcatattcgtataatccgtcccttgtccagctaacaaaatctcggtatcaaattgtgcaaaccccggcagctcccgaccgagaaagctccgcggatcttcgaggttaatgctcgtcgccagctttaaagaaagacgagaaagatgaaatgagctgtctgtttgagagaggtcagaagcgaaataatggttttccatccgcagcaaatgtgcaaacacgtcacccggcaattcttcagcaatcccataaaaagagtcagacgacggcctaagttccggccggagagacgtcagcacaccggatagaacaaaaatcacgataaggcttacgataaatagaaagatggcttttaccgctttcccgccatttaccgcaacaacaatttgtctgtttctgcgtttatttctcattgaatccctccagcgcttgtctagtaattactctatgaacaagctagaggaagtagaactgtttagtgattgtaggagcctttgttttcttgtgacactttttcatgaagcgctgtgtttaatccgttcgctaaaacatttgccatatcgtcgataaatgaatcgacttccttcggcgtaaccattaagttgtgccctaaaggcgaaagcacctcgtgaatgagctgtcgtttttcatcttcttgaagggttccgacaatacctaggaacgattggcgctgcttttgatcgggaagatcttcttcagtgagcactttctttttcccaaacgtcatgcctgccggaacaagcgatcttgatggcctgttatccttcatttctctgccaaaatgttttaatatgtagtccaccgtgtcgctggcaattgtcacggcatcaactactgtcggaacaccgatagcaatcaccggaacaccaagcgtgtctttgcttaaatcttttcgtttattcccaactccagatcccgggtgaatgcctgtatccgatatttgaatcgttgtgttgaccctttccaccgcccgcgccgccaacgcatcaatggcgatgacaaaatcaggcttcgattgctcaatcacacctttaataatgtcacttgtttcgattcctgttatccccattacacccggtgcaaatgcactgacaggcctgtaaccctcctgtacgttttccggctgaagcttaaacaagtgccttgttaccaacagattttctactgccatcggtccaagcgcatcaggtgtcacgttccagttgccgagcccaacgatcaaacagctcgcatcttttgagatattaaggttttcaagaaaagctgagaattcctctgcaaagacagcagagaccttctcctgcatttccgaatcattctccctgattccctgtgcttcaagcgttaaatagcgcccttctttttttcccgaaagctctgcgccttcctttgtaacatcaactgtgcggattttaatgccgccgtgatcacgctctttttcaataaagcctttaatttcttttgtcggcacagcctgctgattggccattgcttccttcgtttccactgccaaatcggtacgtatcaaatactgattcacatctagctcactttttttcatacaggggcctccttcacattaagtacctatattgttgccatttgctgaatgaatcatgctaaaaagagaaccttcaatgaaaaatactttacatttatattgcaatctaaaggtgtgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgttcataacgcgacaatcaaatctgctatgcgtactgcaatcaaacaagttgaagcttctgttgccaacaacgaagctgacaaagcgaaaactgctcttactgaagcagctaaacgtattgataaagcagtgaaaacaggtcttgtacacaaaaataccgcagctcgatacaaatcaagactagcgaaaaaagtgaacggactttctgcataatataaaaacgatcctcaataatggggatcgtttttttcatttctttttaacagctgtaaaaggaacagttcgagcaggagctgcttgtcctttttcccggttttcatctcatagtccatgacagcaagctgttcaataattgaacggagctcctcctctgaaaaaagccttgcttgatccatcgccagctttacccgaaatgggtgaacttttagattagaagcgatttgtttttgtccgtatccctgttccgcgaagtactttgtctgcagaatcagccggaactggttcgaaataagcgccataattttgatcggttcttcattttgtttaagcaaatcataaaaaatttgcagactctctgttcgttttcggttgacgattttattgatcagctcaaaaatattttgttcaaggcttctagcaacaagcatttttacatcatccagcgtaatttcttcacgatctccaataaacgtgcagagcttttgaatctcctgaaaaatcgatgacagatgcccgttcacaagcagaaccaaatgctccgccgcttccgtaccgattgttttctgctctgtttttgcaaggttgacagtaaagtctgtcgtttcctttgcatttaattccttcgcctccatcataaacgcgtgcttctttaacgctttcgtcagctttttccgctcatcaagcttttcatacggagcaagcaggacaaagactgtgtaaggcgcaggtgattgtatatatgattcaagcgcactgacgttgtgctcaattttttcttttttcttttcacctgttaaaaaatatggatttttcacaatgacaagacgccgctcccccataaacggaaacgtttcagcatctgcaatcgcttgatccagcgggtcctcttccagatcaaaaacggacagattgaaatcctttgtctcctgatcaacgaccgtctgtctgatcctgctgacggtttcttgcagcagatatgtctcttttccgtataaacaataaactggatggacatctccttttttcaggcttttccacacatcaaataccattgttgtacgacttcctctctttcatcatccccttctatcctaaattgagtttggaaaatagtaaagaggaagcctgactgctgcttccccatttatattaaacgcctgttcgcaagcccccgggacagcttgtaaaaaggcgataatcaccagaacagaaaacgttaccttagcttctagatttttcaaaacaattccattatacttaagtcagtcaggagggataaagttgaatgattttgaaaaaaacgttcaaagcaaacgaaatgatgctgtagattcagctgttggttttgttgtgtccttcggatttttcgccttcttgtttgtcatggcaacggttattcacctagttggttcataacagcgactgcccgggctgctgatttctcggcagtcttttttagttcgtctctgttatatctgatgtatcatatggaggatagacagaaaaggttccaactctgtttttgtatctatattggatcgttccgttttgatctgttcgcagcacgcggatagaatgtctctgtaatagttgcagaacttcttgatgaggatgatggtaccgattgtttttcccggctgagataatggccgttttcggctgaagctgttggatgaattcttcaccggtagagcctttgctcccatggtgccccacctttaagacatctgctttaatatttggaaacacgtccatcacctcctgttccccttctttctccagatcacccgtcaagatccagctcagaacgcccgtctccatccacagaacgagagatgaattatttttgcttgccggatcaggtgcttcaggtgacagtacatggaactgcaaatcctttatttgcaatacatcgcctcgcttcacctcttcaattgtcactccctcttctctggctgtctgcagcactttctcatctttaggttcagaaacgaaccctttcggaatcacgaggcgctttactttatgatgcttcagcagagtctccgcctctccgatatgatcttggtcagcgtgcgtcagaattaaagcgtcaagctgtttgattcccttagcagttaaaaacggaatcagcatcttttcccccagtgaaaacggatgctgtttttcgcgccaaggctctgacgagtaagacaaagtgccgccggtatcaattaagacacgaccccgctgatgcggagcacctacaaacatgctgtcaccctgtccaatatctatcatatccacttctccttcggaactaagacacggatatataaagagcagaaacagcactgtgcagcaaatgccgccggttaccatcaactgcgacaaggagcgtttttcaatcgccataagcaataggatgatcgtgaccgtgaataaaaaaagcagaacaggtgcaggatgtgcgatcataatcgtgaacacatcaacatctgcaatttttgtgattaacctattggtccagcttatcaataaatcaaaccagctgaaaaacaatctcccaaacgaagcggaaagacttaatagaagaacacctgctacagctcccggcaaaatacagaaggtataaaatggtaccatcaacatattcatcggtacgctgatgatagaaaactgatgaaaatgatatagaagaatcggaagcgagcccagctgagcgatgagtgatacaattgtcagctgccccaaggaggttttaacctgctgaaaaatagaagaggatagaattaaagaaaaactgacggcgaacgatagctgaaaaccggcttcaaagagatgataaggattgaagagcagaaggacgatgtatgaaaggcaaattgcagttgcagagtggacacgccatttgacaagacttccagctaagtaaacacccgacatgagagcggcgcgtagcactgaaggagcagcgccggtcaacatcacatagagcggcagaaataacagcaacagaattgacgccttttctcttgttataccaaggcggatcatgatataaaacaaacctgctgtcaaaatccccacgtggagtcctgatattgccaagagatggacaacaccaagcttttgatacgcggtaagcacttcatcctccacataaaatctgtcaccgactgtaagtgcctgtacaattcctgccgaatcaggaggcagcaggctgtttgtgaatgatatgatatgttttctcaagctgagcaccttgtacttgaaattttcaggttcgctgcagttttggatagacgtgacagagtagttccaatgaatatgctgccgataaagatactcgttataatcaaatgcacccggcacagttgcgtgtttcggttcttccaatgtaccagtcaactcacatgacattcctggttctatgtataacagctgttctttttcaccagcagactgaatgcgatacgcagcagcccatttttccttatcaggtgtcttaaccatcatagacatacggtcgccgtcaattttgggaatagtggcaatcactgccttgaattgataggttccctgccgataggaagagacattctgagaatctgtgactgcatacagtacaaaaaacaatataaaagagaagaaacaaacaataataagaaaagcgtgcctcgttttgattaaaatgatgaggagaaagaggatgaaaagaaaaatagcggggaaataagcggcggcagtaattccaaccgttgccgaagctgccgccataggcaataacaaacgcgaattacgcattcatcacacgtagctcgtgaaaagtgtattcgcctgttcatgtatctttttcaattcttcctccgctaaaccggcatcggccaatttccctataagacccgctacaaatgaaagcttttctctgtttttcagatcaacgatcatttcatcgagttcaacctgttcaacagttacacccgcctgttcaaataattcctgcgcatacggatgtgttttgtaatcctcagcataataaaccgttttgataccagcttgaataatagatttgcagcattgaatgcacggataatgcgtcacataaatctccgctccatcagtcggcaccccaaacttagagcattgaagaatcgcattcatttcagcgtgaatcgttcttgcacaatgatcatctatcattaagcatccttcatctgcacaatgtacgccgcccgcgattgacccgttgtagcctcctgctatcatgcgtttgtctctgactatagtagcgccgacagataatctcggacatgtgctgcgcagcgccaataaatggctttgagccataaagtattgattccatgaaattcgttccacgttgttccctccaaatgttgtattgcctgacctttagtttacctatcataatgcatgaccgtcaaatcactttactgtaatggaagactttattttctcaaatgacttttcacctattcctgaaaccttagtgatatcttcaattgtttggaaacgaccgttttcttcccgatatgcaataatagcttcagctttggatggccccacccctgagatgccttgtaactcctctaaggttgctgtattgatattcaccagcgctcccttccctccatcgctttggacagacactccgccaccttgctgcactgctgtttcctctccctttttcgggatgtacaccactatcccgtcctgcagaatctccgccaaatttacttgcacttcgtctgcttgttcactggtcccgcccgctttctcaattgcctgagatactctgtcccctgttcgcatttcataaacgccaggatgctgaacagcacctttgatgtctatcacaattgtttcgtttgactcgtcgttgtttgcttcctgctttaccactgtattttctgcctctgttggtacagcttgcttcaccggctctttatttttccctgtggccagaaagatcataattgctgtgaaaacagccgcagaagccgctaaaataattgctttcttatgctgattcaaccaattcatcgtgcatgttccccgctttcgtcatattttattttcataacacatatggtttagaggataatagctcaaaggaggggaaaccattgaagataggctttatcggcacaggaaatatgggtacgatccttatcgaatcatttattgaatcaaaagcggccgatccctcaaacatgacaatcacaaaccgcacaattgaaaaagcgttacacataaaaaaccgctaccacagcataaacgttaccgaaagtctcgaaaagctcgtttctgagaacgagatgatttttatttgtgttaagccgcttgatatatatcctttactggcaagagcgttaccttatttaagaaaagatcatattctcatttcaattacaagccccgttcaaaccgaacagctcgaacaatatgtgccgtgtcaagtggcgcgagtgatcccaagtattacgaacagagcgctggcaggtgtttctctcgtcactttcggcacaagctgcagcgaatctgcaaaagcgaaaatcaatgagctgatgcagcatatctctcatccgctgcaaattgaaagtgacatcacgagggttgcatcagacatcgtaagctgcggccctgcttttatgagctatctgattcagcggtttatagatgcagctgtttcggaaacatcagtgtctaaacaggacgcgattttgatgtgtaaggaaatgcttgtcggaatgggaaaactgttagaaaccgaattgtataccctgcctgcattacaggaaaaggtttgcgttaaaggcggtgtaacaggagaaggcattaaagcgctggaaagcggtgtgcaggatatgtttcaccgggtatttcaaaatactcatatgaagtacgaggaggatatttccgcagtgaaaaagcagtttcatgtgtagacgagtatgtcataccttcgtctgtactgcaaaagcataaaaaagcattttaaaaaaccatcgttttaagaaacgatggtttttgatttctgcgccttgaaaaagaggcgttctgattgtgctgatggctcggaatccgtaaaatcagctgtcacgtgatggagctgaaagccgcagttcttaagcatttcttcgtattcttccaccgggaacgttctttgctcgtgtgtctcatcaaaacgatcatacgcttctccgttccacacaaaaaacgacatatcatgaatgacagaaagctcgtcacttccggcaaagctctgccaaatatagctgatatcttcgtcctggttagcaaatgtgctatccggaaagacttccgcaattttaaaagatgaatgaacatcaaacagcaaaatgccttcaggctttaatacccgaaatacacttttaaaggtttcgatcacatcattttttgtttttaaataatttaatgagtcacagcatatcacaacagcgtcaaactgaccgtcaaagccggtgatctctctcatatcctgctgaagaaataaaataggctggctactcgataccttttgctgggcgaaagaaagcatctcttcgctgagatcgatgcctgtaacctcgaagcctttttcggcaagccggatggagatttccccgtgccgcatgctagatcgagaatacggcctttttccgggagggatgcttcaatccattttgtccattgatcgtaaggcgcgtgtgacattaactcgtcatacacgcttgcaaagccttgataaatcattgattcattccaagatcaagatctgcgagcggagcgtctccccacagcttttcaaggttgtagtagcttctttcatccttgtggaagacatggacaattacatcgcctagatcaacgagaacccatcttgcttcatcaaagccttccatctttttgacttgaatgccgttttcatcagcctgatccttgatttcacgggcaatcgcctgtacctgtttatctgaatttccgtggcagatcagaaaataatcagcaaccagagaaataccttccatatccagtgctaaaatatcctctgcccgtttatcgtcgcaagccgcagctgcgatctttaaaatggacttttggttcattcacaaattcctcctgttcagctgccagacacaagccagttatacgttaaaaatgtgtctggaaaaaccggttgattttttttcataagaaaaaccattgtatttttaatggactgaatcagcgcttgattcaaatctgtctcagcaagcttacgcacctcatcgacaccgggaaatgcccgatttggctcaatgtaatcagcaacgtaaatgactttttctaaaagtgtcatgccggggcgccctgaggtatgatacctaatggcgtcaagaatgtcttcatcttgaacccctgcctctctttggaccaaataagcgccgaccggagcgtgccagagctccggattatgatccaataaatgcgcaggcattttttctcgcgcaataatttgtttcatttcttctttcgggcggaatttggcgtaatcatgaaagattgccgctgtttccgcttttttagaatcggctccaaaacgctccgcaagttcgatcgccgtgttcatcacgccaaccgtatggatatatcggtgttcggtcaattgctgcttcacgcatgcaagtgcctcctcacgattcatataaaccattctcctctacatacttcttcactttatcagggattaagtagtcagtgggcttcttgcttttaaaccgttcccttatcatagttgatgatacctcaaattccggaacgtctgcaaagagaagcggataaggggtttcaacatgaaaaccggggcgctttactccaataaattgaatgaggttcagcagctcgtccagcttataccatttcggcaaatattcaatcatatcagcaccgataataaagaacagctgatcatttggataacgctgcttcagtaaagaaacggtatcaaaggtatatgatggcccttctctttccatttcaacaagctccagcttaaaggacggattagattgaattgcaagctttagcatttccacgcgatgaaagctgtcggtatagtcttcgttctgtttatgcggcggaatttgattaggcataaaccaaatttcatcaagccccgcctggtacagcacctcattcgccattaagaggtgaccattatgcggagggtcaaacgtgcctccgaaaattccgattttcttcatttcaaccacctttaaggaagctcgatttgtttattttcctttgattccttatataacacaatcgtattgccgattgtctgcaccaattgagagcggcttccttttacaagagcttccgctacatcgtttttatcctcttcgcaattctgaagcacgctgactttaatgagctctctcgcttcaagcgcctcagcaatttgtttaatcatgttgtcgtttactccgcctttaccaacttgaaaaatcggcgttaaatgatgcgcttttgaacgcaaaaaacgtttttgtttacctgttaacattctgttcctcctaattttcctattacaatggatctcattttttcaatattaggctcttgtccagtccacaattggaaagacaatgctgcctgttcaacaaacatgcccacaccgtcgagtgttttcaagcctttttggcttgcttcttttaaaagggccgtctgtattggattatacacgatatcacatacgacggcactgctcgcggcacgctgtaatgaaagcggcacatcgtccacgttcggatacatgcccacagacgttgtatggatgataacatcatactgctcaagacgttcttctgcttcttttatgcttaatacttctttattgtgaaacgagggagtagcttctgtaagccgctttgctttttctaacgtccggttgcaaatgtcaaattttttcggggtatttcggacaattgttgtaaaaatggctctcgccgctccgccagcgccgatcattaagaatgacagttcagagatgggcttgtctaataccttcattaatgacttcacgaagccttccccatcggtattgtatccgacaagcttatctccctctcttctgaccgtgtttacggcaccgagcacttttgcactctcatcaatatgatccagataatccataatggaaaccttgtgcggaacagtcacattgattccttgtacgcctagagctcttattccttttaccgcatcctccagatcattctcttctaccttgaaggcatgataatgtccgtcaagcccgaggtctttcaatgatgcgttatgaatatcaggtgacatagaatggccaatcggatttccgataaccccgtacagctttttcatactcctctccccttttcttaaattaatgaacgccgaacaaatacatgaacgccttttggcgcgtatgcagttacctttttatcggcgtcatggacagtaacccagcctaacccagagaaaacgatatctgtctttttgtcttttatcgtaaacgtatgggcgaccaattccggaaactcatccatttcatctttacccggaggtgtgagcaattcccctgcatgcttttcataaagcgcgtctgcattttcaagttttgttctatgaatcatcagttcattcggcatatagcaaataaaaggagatctttccccagacacataatcaaaccttgcaagtccgccaaaatacagtgtttgctgatcattaagctggaatgtgcgaggcttcagctcctttttaggagataatattttcagatcctttttattgacataatgcgccatttgatggttgttgataattcccggtgtatcataaagcgatgaaccgtcatccagcgggatttcaatcgcatcaagggttgtgccaggaaattgggatgttgtaataatatcttcttcacctgacacttctttaataatccggttaataaaggttgactttcctacatttgtacatccgacaacatagacgtcttttccgttgcggtaatgctcaatcgcgtcaattacttctctgattccctggccgcgtcccgcactgaccaaaaatacgtcaaccggttttaagccaagctctttcgcttcacgcttcatccattggatcagacgctctcttttcagtgacttaggcaaaatatccgctttattgccaactaataagatagggtttcccccccaagcgctgcagcccattaatccagctgccgttaaaatcaaaaatatcaacaatttttacgacaagagagtccgtttctccaataccgtgaagaatgttcaaaaaatcatcatcagttaaggagacatcttgtatttcattatagtttttcagtctgaagcaacgctggcaaatcacattttctttcgtaagtgatgcaggcggcgcgtaccccaaacctgttttgtcctcggtttggatcgtaactccgcacccgatacaaacaaccttttccatttcttactcctcccactgaatgtgcccttttcgtttgagagcactcagtattctgcgttcgacctggcggttaaagcgcgtaatgaatccgtcagaggaagcgactggcacgaccaaaatcgtatggtagccgtttcggtttcccccgagtacatcggtcagcagctggtctccgatgacaacgcagtcctcttttttcagctccatattgcgcaccgctctattaaaggctttacccatcggttttctggctttatagatgaatgggattccaagcggttctgagaaaagtttcactcttctttcgttattattagagacaattgtcactttaatgccgtgttccttcatttcttcaaaccactcgatcaatcgcggcgtcgcgttcggcctgtcccattcaacaagcgtattatccaggtcagtaataattccttttacatttcgttcctttaatttctcaggtgtaatatgaaaaatattttttacaaactcgtcaggtaaaaaaaacttttttaacaaaacccgcacccttccctttttctttctttcaaaatgattgtcgaaaaaaatcgaacttgcgcctaaagaaaaactgagcaaaaaaatttcgacaaaaattgggtttcttcaccaggtgtggataaatttacacacactatccactcttattacatcactctttagacaaattataaacacgatactcacaagttatccactttttggtgtggataacagaacgattgttcttatatgcatttcatggtagattaaagataacttcaacctcagatgaacgcaacttatcattgtatgcgttaaaatcatgaatgattccaacttttaaggaggtgcctctcccattaattgggttcctagcatgagaaaactgtctgatgaattactaatagaatcttatttcaaagccaccgaaatgaatttaaaccgtgactttatcgagttaattgaaaacgaaataaaaagaagatcgctcggacatattatttccgtatcttcttaataggaatttgtctattttttccgggcgtatttcctttttttactcagatgactgatattatatcactttggctgcgcgctttactactattttcagcaaaaaacacccctaaaaagaggtgttttaaagggccggttattatgctaaccagtatatgccgcccacaaccaggagaacaacaactaaaacaacaataaaagcgtatccatatgctctgcctgcgccatacatgtgaagcgcctccttaataaggttttataacagcctatgtaggagaaataaatcggactaggcggttgtccggctcaacgctgcaggatctgcccatcttgtattccttcatatacgatccttgcccctttaggtgtcatatgatttccagaaggatctattaaaccagattggataagcgcttcatcagttgcttttccgccgtctgcttctataaaatgcttccagttatctacaagagggacatccaggcgcttcgacacatctcttgtaatatcgttatatgagttgtgccatttccttgctccgccttttggttcaaaagcagctgcttggtatctggaatagtaaaacagatgatgcttcccattaccttctataattgggatacacgtcattaagataggcttgatcccgtgttttctgctttcttcaataaaataaaccagattttctctaaaacgctgcttcgacactctcggtttcccttcagtcagtatggcagcgtcattggtgccgaacataataaacaaatacttcggtttttgatccagcacatctgtctgaaatcggagacgggcatcctctgtcgtctgtccgccgattcccgcattgagtatatcaaggttaccgcgctcagctgtttttaatatattgacccactgctgtgcttttggataatcgcgataatcccaatttgagccacgcgtattactgtcaccaaatgctacaacgtcttcgtatccccttccctcgcatcctgctgtaacgaacagcagaaggaaaaggatgataaaatgtttcatctttacaccccaaaagcctcactttaatgttatacctctgtttctcttcgttcaatgaagagtttttcgctatcactgttttttcctatagttaacgtgtccccctcagtgaatatcattctgctttcattgcggcgcagctgatgattttttaaaattcccttctttccaatctgaaaaacacacaaaccaaagaaaagaaaataacctgaatccgcactggaaacaggttatccgttaaatcctgcatttactttaacttcgatttaagcttggcctttgtttttggcccataaatcccgtctgcagttaatccgttcatgagttgaaaacgcttgacggcattcgctgttttcggtccgtaaactccatctatgccattgtttttggctcccttatcagggtaaaagtgaagtgcagctaaagccttttgcagctggagaatgtttgtgccctttcgataaggcgaagtgagctttataaccccagacggcagaggatatgatggtgaagattcttttggaggtgtatccgaggaagaaattccgtttagaaaagagttccagtggtccaagagtttccgcggacattctttcccggaccattttttgtggggaacaacacgatttaacggaatattgttttccttcatcagctttctgatcagccactgggcatttgatgttgctttttcaaaatcgccgtcagcattttcacagatttcaatcccgatcgatttgcggtttcctgtcccgtttgtaccgtctcccgcatgccagccgttttcatctatcgggagatgctgataaatgactgaatcgtcaactgtaaaatgccagctttcggatgtgttcgggtttttcacaaaattggagtgcattttcgcatcagcgcctttggctgtattcgctgtattatgcaccgtaatataagcaggcgtcatcgcatagccaggacgattatcatttgataccggtataaaatccttttttatggttaccatttctatccctccctattattaagaatgcagaaaacagagagatggacagccttttttatgaagtaaaaaagaattgtgttctcaacctggttttcagttgaaccgctgaaatggcaccagttatactaatttagatgacggaggttttggctcctgacatcacctaagttgggagtgaccatagacatgttaaaaaaagtaataggtatacttgtgattatcgctatcattgcagtcggtttttttcagaaagaagcttggcttgatgcaatcaaagcaggagggatgttttccgttttatttagtatgctgctgattgctgccgatgtttttttcccaatagtgccgtttgcttttgttgctgctttaaatggcgcagtgttcgggactgcaaatggaatttggattacactgaccggctcaatgcttggtactatattgctgttttttctcgccaggtacagttttagagattgggccagaaaaaaagttcaggcctatcctgccatacagagctacgaggcttccttcaacaaaaacgcttttaccgctgttttattaggaaggctgatacctgtcataccttcacttgtaatgaacgtgatctgcgggctgagccaagttcgctggcatgtttttttctttgcgtctttaatagggaaaatccccaatattgttgttgtcactattgcaggtgccaatttcaccagcaataaattattgtctatcagcatttacggtacatatattctgatcatcatggtggtcatttataaaaagttccctcatcttctgaaggtgccaaaaaaataaggaggcttgtttggccccttactttttttctgtcgcatggcctccaaattcatttcgaagcgcagcgaccacctttcctgtaaacgtatcgtctgttaaagaacggtatctcatcatcagtgacatggcgatgaccggagttgccgtctgcagatcaagcgcggtttccaccgtccattttccttcacctgaggaatgcataatgcccttgatctgatccagtttcgcatccttagaaaaagctcgctcagtcagtcccataagccaagaacgaatgacagaaccatgattccacactctggcaaccttctcatagtcaaaatcaaattggctgttttcaagcacttcaaatccttcaccaatcgcggccatcattccatactcaattccattatggatcatttttaaaaaatgtccgcttcccgcttcaccagcgtatagataaccattttcgacggcggtatcacgaaaaagcggttccacaatctcccatgcttcatggtcgcccccaccataaaacaggctccatgccgtgcgccttccattccgcctgacgttccggcatcgagataatggatacccgcttctttcatttgattgtagcggcgaattgattctttataatgagagtttccagcttcgataatcatatcgcctttacttaataaaggtgatacatcacgcaaaacagcatcgacaatgctatacggtaccataacccataggatacgcggcgggtctaataaagaaattaactctttaagattcgttgtcccctcagccccgtatgctttcagttcatcaacagccgcttgatttacatcataacctaccgcttgatgattgcggtcaatgaattgctttcctatgtttatgcccattttccctaagccgattaatccgattttcatatctgttcctcctgattgtctaaaaagcctttactctttatgttccctttggattgtattgtgatacgcagaaaacaaatggggcttacatcgtctgcgcatgtaaattttatttttcatgaccgacggcgcctgccagttctattactgaatctctttatatccataattatcgctttatccttgatttaccatcagtttaagttaaaatatgggaaggaattcgattttttcagtaaaaagaaggtgacatgttgcagaatcaatctcatactcttattggagttacgaaaaccgctgtattctttttatacgctgcacttgcaatcatcggttttgcaatcgggtattttatcccgcagattgcgaaatgggcattatccctcccctggatccctcttgaaggaccgcttcggctcattacctcttttcagggatctacagctgcatttatcactgctcttctcggtatgtgtgcggggatttggttcgctcattctgttattgcaatgctgctgtctgtcaaaattacagatcacacagtggaattcatcaaaggaaaaaaagtgcaaacaattcattccgatgacatcgctcttgtatttatggatcacaaacggcttgtcctcctgggaacagccggatatgaattggtacgggaagaaattgatgaaaaaccagtaaacgttgagaaggcctttagacagcatcattacgaatgggcaacagatggtgatccgtttaaagatcaatttcgccgatggattcctgatgcaccagacctatcgcaaggcgcccatgccttattaaaagctcgtcataaagcgctgcaggacgaagaaaaagacgatattgaagaattccgtctcgaactggcacagctgggcatcgttgtacgggacgaaggcacacgccaatattggcgaaaagcagaaacctatccccgaaaattcagcacggcgaaggattgtaacaacagaggctcaagaaagagcctcttctttactactgcacaataaacagcactctggtaccgtcaggatagctgctcatttgattccctacccacgagccggcgccgcgattatcagaaggcgtcacatatcggacatcagcccctgcgccgccttcctcgcagaccgccatcggccactcatcccggtcatagcccggcttggtcgggattccctttaaagattcctcccgccttttgtctgctccatctctgtcaatggtacaaatatctggatgtccctctgcaattgcatctctaatatgactgccggtttccggataacgagacagcggaaaatataacactttgtcatacgaagatgcgccttggatctgttgcggaaccattaaacaaagaagaactgctgcagcaagaaacaggcctgccatccattttttcattcccatccccccatacctttgttcatttcaatgtatgtcgcttgataaagattatttttaacatttgaagttagtatgctgcttacaaaagccggactcccccgcgagaaatttcccggtacagacacagacagcctccaggtcacatacatttacatataggcttttgcctacatacttttgtggaggtgacgatggtgacaggtgttttcgcagcgctcggctttgttgttaaagagcttgtctttttagtatcttacgtgaaaaacaatgcctttccacaaccgctctcaagcagcgaagaaaaaaaatacttagagctcatggctaaaggggatgaacatgccagaaacatgctgattgagcataatcttcgcttggtcgcccatattgtgaaaaagttcgaaaatacaggtgaggatgcagaggacttaatctccatcggaacgatcgggctgataaaaggaattgaaagctattccgctggtaaagggacaaagctggcgacgtatgctgcgaggtgtattgaaaatgaaatcctcatgcatttgcgcgcattgaaaaaaacaaaaaaagacgtctcccttcacgatccgatcgggcaggataaggaagggaatgaaataagcctgattgacgttttgaaatcagaaaacgaagacgtgatagatacgatccagctcaatatggagcttgaaaaagtgaaacaatacattgacattttagatgaccgtgagaaggaagtgattgtcgggcggtttggacttgatttgaagaaggaaaaaacgcagcgagagattgccaaagaactcggtatctcgcgcagctatgtatcgcggattgaaaagcgggcgttgatgaagatgtttcatgagttttatcgggcagagaaggaaaagcggaagaaggcgaaggggaaataatgcagaagaggccggatctcatattccggctttctctatttgaaagagttatgaaaatcatttttttcatcgctgataagctctccgagaaagacggtctgatcgtaacaaatgacttgacttataagtcctttgcttgcatccaccctcaggcgattcaaagccggacgttctaaaagctctccagaaaatccttcatcggcatacttcagcacatccttagtccctgctttctttatgcaggcctcgatctggctgtcgatgctcgatcccttgatcgcttgttcctcggtcgatacccttacatatattgctatcaccctggatctccttcctataaagttttattaaataatgatagcaattgttcatgcatttgtcagcttgcggtccctcgatgattattaccttcataaaatgcatcaccccttgggtaatgctacgtaataagtgtttgtcctaatgaggtgattttcaatgagtgtaaaaaaagaaaaaactagttacagatcagtaactagttttcaccttaaacgatttaaatgtttggtttcaccatatcttctggtttaaccatctcatcaaattgttcttccgttagcaatttaagttgcacagcagcctcttttaacgtcaagccttctttatgagcaaacttagcaatttttgcagcattttcatatccgatataaggattcaatgctgtgacaagcatcaaagatccggaaagattttctttaatggttttcgcattaggttcaataccaaccgcacaatgatcatggaaagattttattccatcactcaataactgcacggattgtaggaagttatagataataactggtttaaatacatttagttcaaagttgccctgacttgaagcaaaaccaatagttgcatcattccccataatttgagccgcaatcatggtaagggcttcacattgagtagggttaactttaccgggcataatggagctaccaggctcattttccgggattgaaatttccccgatcccacagcgaggaccgcttgcaagccatctaacatcgttcgcaattttcattaaatcagcagctaatgccttcatagcaccatgtacatacgttatttcatcatgactagttaacgcatgaaacttattaggtgaacttttaaaatgttggcctgtaaacttcgagatctcctctgagacaacttctccaaactgtggatgtgcattaatgcctgtccctacagccgtaccccgatagcaagctcacgcattttatcagttgcttccaatatcatttctttcgaacgatcaatcatatatacccaaccgctaatttcttgtccaagcgtaagaggtgtagcatcttgaagatgtgtacgacctattttaacaatgtcattgaatttttttgctttttcatctaatgtgttccgaagttgatcaagtacaggaactaattgttcatagatagctaatacacctgcaacatgcatcgctgttgggaaagtgtcattcgaactttgactgcggttcacatcatcatttggatgtatggtttggatagagcctttctcttttagtaaagatgttgcaaggttcgctataacttcgttaacattcatattgctttgtgtaccgcttcccgtctgccaaacaacgagtggaaaattgtcatcatatttgccttcaagaatttcatcacaaactgcggtaatagcctctgttttttcactatccaaatttcctaaacgattattagcaatagctgtactgcgcttcaatatagcaaaagctttaacaatacgttttggcattttttcagaacctatcttgaagttctctttactacgttgtgtttgcgctccccaaaacttatcagcaggcacctttatttctccaaaagtatctttttcaattcgatagttcattaaaatagtcctccttctgaacacgaaaatagtttaaaattcatataaaaatttatttattttgctgctaaatttagcttaacactaataaatcatgatgtataatgcataataaatatgattttaattcctttatgtaatgatttataagaagtgaggtttttttatggaatgggaacaattagagtactttcaaactcttgctcgtatacagcatgtaaccaaaactgctgaaacgttatcaataacacagccagcactttctcggtctattgttagattagaaaatcacttaggtgttccgctttttgatagacaaggccggtccattaaattaaataaatatggggaaatattcctcaagagggttgattccatgattcgagaatatacagaaggaaaggaagaaattcaatctcttttaaaaccggatcaaggtgaagtgtctttaggctttttacacaccctgggtacaacaatagttccaaatttaattggaacgtttaaagataattacccaaaagttcaatttcaactaaaccagtctcactctaatttgcttttagataaactaaaatcaggtgagcttgatctctgcctacttgcttcttttccagtcgaatcaaatataatgtggaaacccttatggaaggaggagctttttttatttttgccaaaaaaacatgtgttagctactcgtgaggatattacgttaaacgaaatagctaatgagccttttgttttaatgaaagaaggtttcgcccttcgagtgacaatagatgatatttttgagcaagttaatattaccccaaacattgtatttgaaggtgaagaagctacaacaatcgcaggttttgttgcagcgggtcttggcgtttcaattcttcctgattttaaaggcttagaccaaacaaatatcgcaaaggttcgcattagttggccaaggttcgagcgcatagttggtatttcatggattgaagggaagtatctatcacctgtcactgaaaacttcaagcaatatatcatcaatcagtttcctcaaatagattcgatatagtatttagttactgttgttgaggccaagtcatcgtactcctagatggatttaatagctctaaagaaaaaacaaacaaagaagataccaaaatggctttttggtatcttctttattagttcgttgccctcaataaagtggaagtatattgtcagttacagaagctttcaagcgtctgaagttatctaatacacactcattgcatcattttatatctattttgggcacaaaatgggcacgattttttccttcctttagtccctaacttgatctccaactattatgaaaccaacatttgaggctctgtctgtatctacaaagtgagtaaatatttaagatgctattttaatccatactgccgatgaaaagttcagtcattgcaggttatttacttatttgctttcacccaccattaagatttagccagacgttcaagcagcatcatcccttaggtgatgctatgtaataactgattatcctaatgaggagattttcagggagtatgaaaaaaacactaaaaaaaccgatagtttaaaaaccatgaattttatataaccagcaggccctcaacatagtaaatccatatcattggttatggaagcttattttcattacattccttatattcatttgccctcatttccttacatttatatgaattatggttaaaaaatggtgagcacaaacaataaacgtccgtactacccttttatgactggcaggaattttctgcttcacgtcgaaagtaattgtcgaaaagtaatccaggaggatagggggggttcttaagggactcaaatgttctgatttatgaaaatcaatttaatggaacaactccacatgttaaaaagattttaaaaaagttttttcctttgtcgatttcattaagtcgtattcgttgtattcgtagaaagacaattaaaaatggaaaggttgttgaaatcatgggagcacaattaaactcttatctaatgtcagaggacgcaagaagccaggcggatttttacttagaatcactcggtggagaaattgtatcacttaaaacattcggtgaggtaccagacactccagaagatatgaaggagaaagtaatgcatctgtctttgaagatagctggaaacaatattctgatgctttctgattcctttgaacaagtggtcggtaatcgtagcatcagtcttgctttaacctatgataatgagagcgaagcaagagaggcatataccaagcttggtgagggtggagaaaacaaatatccctttgctttacagccatggggcgcatactatggagaagtgatagataaatttggtgttacatggatgattactaaaccgtaaactatgcaaaataaatcaggattttattgaagcgttaaaagaaccatggcaaaggaactctccacaaatttatgtaagacgtccataaggatataacggaagtccatgaattcaggataagaagccccatttttcgaataacagaaaatatgctgctgtcatcacgacatcgacaaatgctgttcacttacaatctttaatgctaccgaactggaacttcctgaagacatattcgatggtccatcagaaagaaaaacactgaagctctgtgaaggggattcgtttgataccgggcagctagtgttattggtcagccatgcctcaaaatcactttaaatgtaactcattgagttagaaagataaggtattcaacaatcgtgcgctattcttttataagaaagcgtcttttttgcatcccaaaaccacttaattcccatctgagagatttcctggagaaccaaaagttatagcggtgccctattgcctttttctctccaaaaaataagattaggcctcaaggatttaaaggggggactaattatatcgcatttgattccaatgtttctgttgatatcaaataaaaaaacctccatttctgaaggaggttgaatgtaatattatcaagtttgaaaacgatcagaggcaatatgaaatgtgttttgagtttgattttctgttaaggatccgaaaccacacactaaaacaagtgacaaacccaggattaggcataccttctttttaaaagtcatacaggcattctcccctttgaatttgtgtttgagtctcaagcattttctgatgatatacataggatgtttcaaattcttttgagtttgcgtaagcagctgcggtctcacaggcaatgtcttcaatatatgaatagttcttatttttttctaggtattctattgttttattaacaccttgttggtccactgcatcgacataaagagcttttaaatatccctgtaattttgcgaaaagctcatcaccttgataaagagctgctgacaaacctttcttacttacttggatagcctcattcatttttccttgtttaaaaaggattttagcataagaaaataaagaatgtggcaagtttgtgagcttttctttttctgtaatctccactgcttgctttatgtatacttccgcctgctcgtaatcaccgctgtcagcaaaattagtgcctaaattatatagtgcagaactgatcaaccttttgttattcaattccctagataactctaatgccttttcaagatgcggctgacttttttcgtaatgtttaaaatcagtataattccctgaaataacaaacatacactgaactttccgcaccttataaagttcatattgattatagatatctaacgcttgtttaacgtgatgcatagacacatgactttgcttcataccataatatgcttcagctaacttaaaatgaaactctgctctttcaatctcatcagggacatgtataagctgcttttcagcttctctataatagtaaatagctttcatgtattgcttcttatcaaactcgtacatccctctgaaaaacagagaataatacgacaacaggccagatatgcctttatttgaagtctcaattttttcaagaagttcctcaatagttggtcttatacgtgttgttacgggttccaaataatctaacatgagctgatgacggaatttcattagggagaagtaaatgagtaaatactcatcttcctccatccgttggatttcgtgctccacctctgcctttaaaatctctgcatccgggacactaaattgacgtatcattttataccattcattgatctttacgccaacttctgacgaacttaaaaccggattcacaggacccctccttttatgtctttttatgtaatattctaacatttccaaaaagtgtttggaccgcaaaaaaaccgcaaacttttttattcggtttgttcataataaaaaagcaggcattatgcctgcttttttgtaaggactctatccgttctttctcctgtataacggtaaagaaagttattcaagtatttttatgaaatgggcttcttacgtattttatccattgcaccttactatgataatcttcattaaagaattatttatagtataatacttttcacaaacattctgaaattattttcatcataaaaggtgtagcatgatatgcgcaggacgaacagcaatagactatccattcccaaaatagtgtatatactcaaaagcaaatatcgaaaggggaatgcatgtatgaaatctaaattgtttatcagtttatccgccgttttaattggacttgcctttttcggatctatgtctaatagtgaaatgaaggaagcatcccggaatgtaactctagcacctactcatgaattccttgtttgattcgataaacaacattagttctcattccctttagccgttcataacggctttttcttatttctaagaaagataagcgaatcttgttcacctacatacaatggtaataaatatttcactattatctcctctggcagttacagatcaaatttcatagcacttattgattttacaatttgtggatctcggtgcgacccgaaaaggctttctcctttatcaagagttgaaatttgttcgatatcctctaagctcaactcaaaatcgaaaatgtcaaagttttcgacaatccgttctttgcgcaccgattttgggattgtaacgacttcacgctgaacaagccaacgcaacacgacctgggcgacagatttattgtgtttttccgcaatggaagtcaacacttcgttgctgaacatgttattgcgtccttcagcgaacggtgcccacgactcgtgttgtactccctgctctttcataaaagcagcactttctttttgctggtagaatggatgcgtttcgatttgattgacggctggcacgatttcattatgcatgatgagatccattagacggtcggggtggaagttgctgactccgattgccctgattttgccttcacggtacaggtcctccatcgcacgccaagcaccgtagtaatcgccgtatggttggtgaataaggtataaatcaagataatccagctgtagcttactcaatgatttggaaaatgctatcttggccctttcatagccggcatcctgaatccagagcttggtcgtaatgaatagctcctcacgcggtacgccgctccgcttgattgcacgtccaactgcttcctcgtttaggtaaccggaagcggtgtcaatcagacgataaccggccatcagtgcttcatatactgcgttttcacattcttgagcatcggggacttggtaaacaccgaagccgataattggcattttcactccattgtttaatgttacggtttgcattgtaattcctcctattgttcaaatgtagaacgacaaacagcacgcagcgcgaaaatcgggcacacagaatgaattccgctacgggtagtttgcgttataataagcttattaccttcgtgtaacacgaaggctagcactttttaaaaaatttttaaaggaggattacacatgcatacagtcaaagaagcagcgatgataaccggactcaccgagcatgcggtgcgcttttacacggataaaggcctggtgccgagcgtgcagcgcaataaaaacaatattcgtttgttcgacgaagaatcaatcaactggctgtttggcgtcaaatgcctcaggcaatccgggatgccgattgaagtcattaaaacgtacgtgaatctctgtcttgaaggagattcgaccattccacaacggtacacactcatgatggagcataaagaagaagcactctctcagctcgaagaagccaaacagcacattgcccatttggaacaaaaaactgccctatatcaggcaattatggagcacggctctcctgatacaactaatcccgccaactgggaaaaaatacagcatatgcatagtgacgtattttactcacccactgtccggtagatttgagagatattcatgagcccatcaatcgcttttaaacttctaaattggaatccatattgaatatgctaagttttatgacagattatgagggattaaatttgtttatatacggcgatagggctgaaagtccttaaggttactttctattaaatataaattgataggagtcgcatctgtatgcggcttcttgatctggactatatattatataaattcagattctctttacgatctttccctggaggcttgccaaacatctttctatactctctattaaaataagaaggactttcatagccaacttgaaaagcagcatcagcaatcctcatatctttcccgaaaatcaaccgccttgcttcatgaagacgtaaagctctctggtattggatcggagtcatcattgtaacttgtttaaaatgatgatataaagctgatgggctaaggtttacttttttagctagtgcatctatctttatttcctgagaaaaatgatttcttaaataattcagagcagcagccacttcagataatttactccccttggcaacaaggctttttactgtgtgaccatgctttccctgcataatgcggtatagaatttccttaatgattaaaggtgaaagtatttctgtatcttcaggagtatgaagtagcttcacgagtcggataagtgcatccagaatgaccccatctgtctgatccacaaatattcctcggcctgtagcattatgattagtactatgttgcttatactcttttgagacctctgcaatttgcattaagttaaaattcaatcgaagacataaataaggttccatctcacttgcttctaaaatttccccaacaacaggtaaatcgacagctacgactaagtaatccccttttccataaaagaagtcttctccaatcatagaaatcacttttttcccttgcagaacaatacacaaagcaggttcatgcatagtatggacaggcaccagcggcttgactgatctaataaattccaacccggagattgacgttacgttcgtaccctccttggtagcaaaggatgacacaaggtttgtaagctcctcttctttcgattgcaattgcacttctagagacatgaaatccctccttatataaaacttatcgacacttggaggatagggcaagaattaaagagataccggctaccactccatattcactttacctgatactaatagtagaacaggaaaggagttgatgaagtatgaaaaaaaccactcattcttatgctggactttgggttaccaaagatcggtatattaggcatgaactgctgcccgatggacgctatgttgaagctcgcggcaatgtcgaatgtgcatatacaggtcattaccaaataacagatgaccacattgaatatcaagatgatacaggattcacagctgatggagattttataaacggaattctatatcacgcagggatggtcctgcatcgtgaaagaagctaaagattccttaaagaaaaattacttaaaagaggatgatacaaagatgagtataaagaataaagttgttcttgtcaccggcggaagcagcggtattggagcagcaacagttgatttattagctgagaatggagctacggtaatagcagcagcgcgacgaacaaataagttagaaacactcgtatccactcttctccaaaaaggatatcatgcagattacaagcaactggatgtcacagactttgaacaaatgcagcataccgtccaagaaattatagaagcatacggaaaaatcgatgtcatcgtaaataatgcgggtgtaatgccattatctaaattggaatctctgaaaatcgctgaatggaatcgtatgattgatgtaaatatccgtggagtcctgcatggtattggtgcagttttgcctgtaatgaaagaacagaatagcggacatatcgtcaatatagcttccataggcgcatatgaggttacctccactgcagcagtttattgcgcaaccaagtatgctgtccgtgccatcacagaaggcttacgacaggaagcaacgaataatattcgagcaactgtaattgcaccgggcgtaacggtatcagaactagccgaccatattaccgataaacaggcgagtgaagctatgatcgaataccgaagacaagcgcttcctgcttctgcaattgcacatgcaattctttatgcaatctcgcagccactagagatcgatgtaagtgaattaattgtaagacctactctatcactataaaaagagtctcattatgtatgagaaatagaatcataagaggattgaagctaagaattaatgttgatactaataagaaactgagttaggtggggccgagaaattgaactcggccttttaagttagagcattatggtattggaatacgctgtgttcaattaattaagagggcggtatggtgactgtagcgagtatggcggaagagtaccattcataacctcccttttattgggatttgaatcgattatagatatgcaaatgtaaaacggattcacaggaccccctccttatgccttctatgtaatattccaactttttgagaaagtgttacacccgcaaataaaccgcaagctttttcgtctatatcttttgatatgattaatcaagataatttaaagttcgtttcttctttcttccatggtaatattttgttatatgattaaatgagagggtatgattatgaaagtctttgaagctaaaacacttctgtctgaagctacagaccgcgccaaagaatataaagaactaaggacgcaaatggtcaacttgagaaaagctttacaaagcgtcgctgaactggacgacagcgaattctcaggtaaaggcgctaataacattaaagcattctatcacgatcatgttggtgtcactgatcaatggatcgactacattgacatgaaaatcgcattctttaacagcattgccggagctgtcgaggacaaaggtctctctgttgcttatattgaagaatcttttttagaacatgaactggctaacgcccatttaaaatcaaagtccatcatgtctgaacagaaaaaagccatgaaagatatcctgaatgacattgacgacatccttccgctcgacttgttttcaacagaaatcttcaaggatgagcttgcagatgccaatgataaacgcaaaaaaacaattgaaaaactaggtgatcttgacgaagatttactgacagaatatgctatgtcagaaccaaatgaacaattcatcaagtcagatttccaaaagctccaagaagcaacgggcaaaggtaaaaacgctacgcccatccactacaacgctaaggcgtaccgtgagagtgatatacataagaaaaaaggtgatattgagaatcgtacagaggcttatttgacgattaagaagaaagaagaaaaagaacgggaaatcgaaaagctgaaagaaagactgaaaaattacgactatgctgatgcagatgaattctattcaatggctaaaactattggttacgataacctaacagaggatcagcaaagatatttcacacagattgaaaacacacgtgagttgctggctggagccaaaggtactgttacagctctttatgatatgacagctgaaacattagactatatggcacacaatcatcctgtcgacatgcttattaattctgcagttgcagtttatcactatgattccacatttaattcaattaaagatgcaattttaacctcctatgtaagagacgtaaagaacggtgacacagaatcaaaggctcattggtttacatatgcagcagtaaacatctttggcttaaaaggtgctggttcagttgctaaaataggagtgaaaacagccggaaaagctgcagtcaaaaaagtatcaaagaaacttgatgcaactcctgatcctctttcaactctgaaaccatttgttatgagagaagaagttgtgacagttgagggctttccctataatgttattaatgatgtaagtttgaaggatcgtttgcttcaattaattgaagctgctaatccaagaaaaaggctacctagaactaacggcagatgggaaggaactccgggtaacggaaaatggtattcggataaaccagaagtaaacgaagttaccaaaggggaaccggttgctttcaagaatggtcgtcctgatttttctccttggacagaagcaacaataaaatttaaaccggggaattaaatgggagccaagatgactttactaaagtttatgagagaattaaagaaatgaagggatttaaaagtaataatcaagcaaaagagtggttaagggatgttaaaaaagttacacctcatcattttgatgggaatactattcaactagtaccaaccaaactccataaaaacattccacatataggttcagcgtcagatttgagaggaggatataaataatgagttttgatgttattaaaaacaaattagagcaatttgatatcaaaaaatacggtgagaatacatattcagaaagtgacgtcattgctattgaatcgaagtatggttttacattgccgctagaatataaaaatttccttctggagtatggagagtgtgcatttaatgaagatgacatttattgcaactctttagaagaaaacccttgggttaaagataaattaataacggtcgatttattttatggattaaataataatgataattcacttgtctacaacatagaggcatataaagaagaattccctcaaggaagaatcccgattgcaagttgtccaggaggaaatgaaataagcttaactatcgagggcaattcgatcgggagagttcatttttgggatcatgaatctacaaatgaacgggaagcattttatttggttgcggaaagctttactgactttatcatgaggtttagtaagcagataaaacataagtcttttgatgattcaggaatagaatcaatggaatttaaagatggtttttttgatgattaaaataagatttatccaatatgaatgactttaaaaagaagagtcacttacaagcccctctcaatgagaagggcttattctatttacaatctataaatggctatattaacgaagttttataaacaataaacttcatacttggcatcatcatcaaaatccaaggagaatacaattagttgaccaaaaggtgcatcggaaaacaggccatacacctttgaggtggaggaagtaagaacagataggagtcggtaatatgacagaatggagatttgccgaagagccaattggggaaacaactgttaaaaaaatcgaaaaggcattagatattaagtttccaaaagactacattacaactatattaaacaacaatggggcgcgcccaagtaaaaagatatttgactttgaaaatacaaaaggcgcggtttttaatcgattacatggtttaactgaggatagttcaagttttattttagaggtctttgaagattaccaggatggaaggatgcttcctgggatagttccttttgcttgtgatcctttcggtaacgaaatctgcttcgattatcgtctgaataaagagaatccatccgtagttttctgggaccacgagattgcatatgaagatccagataaagctttgagtcatatatatgattcatttacagagttggttaataaactatacgaggaataaacgaataaagcctttccccttctttttgagcagaaaggctctttaatactttctccggtataaaaagatggaaagcccttctcgttatagagggctttaattgggagtgaaaatgaaatggataataaaactaaagaattaattaactatttctttaaggttatgggtgatgaacgatttttacgaattttagagaaattctccaacggagagggttatggtatagagaatgtctggtgtgtatttgctgatgactacgaagagtgggaagaagattattttggagatgagggtatagctttttatttcgattacccagcaatcgaggaagatgaagaagtcatattagattacgaaaatttctataaatatttaaatgaaattgttagggaatatgtagaacgacacccagaaaataaacccgaggtagagaactacatgaaaagaattaaggaaaagtatgatattaagatataaacaaaactgcatatccgttatataaataataatctttaaggtgaaataacatatgaaatattcatataaatttgaagaagatccatttggtgatttaggaatagtattgccagaagaaatcagtatcttctctgatttcattgaaaacatcgctacagaagaacaaaccaacgagtatatagattacattgagaaaatttcagaagggatatatgaagactttgagattgagttaaatgctacaaatgttctcatcaagaaagatgtgacaattgttgaaaactcttttaggatagaagaaccctatgaaaactcaattgaaaccgatcaatttagagaattgctattaatatggcgagataagattccagatatatttaaaggttgaataaaattaaaacccttcttacataaagaagggttttacatatcgaggcggttggtacattcttgacgaaaacaatagcaagcgaggaatcattgttcctgctgtttaccctgatgtagtaactttaaaagggagccatcgctcccttttgttcactgaattacagaactttctaatgtgtatgatccgccagtttttgcagtgctatatccagcaacccttatgctataagtatagcttttactgactgcaatagtatgtttcgataattctgaggaatcataagaattcacaaaagttgtcccaccaccatttacatccgttttgtaaatactaacttttaacggagttgttgtactatctttggacaaataaaactttacttttgtggctgatcccggatggaattgccactcatgcccttctttagcagcagcggcatcagcaaaagatccacttaccttgtcattaagaggtagcatacctttaaattcataggctgaagcacttcccatagcagtaaacattaaaatcagaacaaaaaacattgatactaacgactttttcatttcacatttcccccttttaaatttaagtcactgtaataatactcgtcttcatttaacaaatcctcccacctagattaaacttcataaatttgacacaataggattataaagggtattctcaatttctgttatccttcaattttcgcttttgtcttaggaccataaatgccatcagcagtcagaccattcattgactggaatcgcttgactgcatttgcagttttcggaccataaacgccatcaatgccgttatttttcgcccctttgtccgggtagaaataaagagctgccagtgcattttgaatttgtgttaccttttcccctctcatcattgggctcttcactttgaaaataccggaaggcagcgcatatgacgtttttttgctgcttgtgtttgttgttttctttttagctatacttgctttgcttgagcttgttttcccacctagcgcctttaattctttttcaacggcagccttaacttgattccatcttccctctgacaaaatacggtgcgggaaatacttgccgttccagtcttggtgcttacggacacgatcaacaccccatccgcgttctttcagtagccgcgccacaaacttaatagcgagcttttccgctgccttatatcgtgcccctcctgacttgctataacaaatttcgacaccaatcgactttcgattccctgtgccgtttgttccatctcctgtgtgccaagcgttacgattcgttggaataccttgaatgacttgcttatcgtctactgcaaagtgaaagctcgttgagctagagttattcttcatatatgaaatttcattggctgctgaagcatcatttgcagtgttgtgaatagtgatatatcagctttcatagggttaggtttagagactaaattctttacaactttaatggccatatatcctctctccttctgtctgtgtaataaaaaaagccactggcttagccagcagctttgtctgcgttattcttactctgttctttttcgttctcaattgtttgtaatcgatctgttatcgttgtagggattttaacaccgatctgtgctaaattttcagttattgacaatccttcattagcgacagcttcctgacgcacgtaggtaaaatatccctatgtgtgtcgtacacctctttgataacaagtgcagttcgtttttctttaagcaatttcagaacaattttgagtgccacatgatagcttttggatgatccataaccacccacaagaaactgaaacttttgattccagtcaaagagaaattctttaaaatgtggatttacatgtttaatcactgtcatcacctttgttcacaatggtgatctcaaaaggtttatcttcttctgtaaattcttcaatctctaattttttcttgtctatacttaaacgcatatgctccaatttaaggcgtcgttcgtcttctgaatgggctaattcgtcaaactgttttataaggttcctgagttctgccattgccctcgattgggcattcaagaacgtagcatgacgatcccaagaaaattggaattcgtattcttcctcttcgacttcgtttgtctcagataggacagcctttttctttttcagttccttaatcatttcctgcttatcagaaacgaacatgattttttgcgctcttataattgcagcatattgaatctgaatttggtcccatatcatatcgacaggggatcgctcctgtattccttccatgatcgatagcgtttcttctggcaggaactttgagaagaatccatgagtcacagcgttttgatttcttagtggagcagcaccacctttatttcctagtgcatttttatttccaagcggtgctcttcctcccttgttcccttttgcgtttttgtttcctttaggtgtgcctcgacgtaaaagagcgctccctttcgatttaggagcgctcccttttattttttcttcccatttatcgtttgctttccatttgcgaatagtgctgcttgtgatacctaattcctcagcaatgtcttttaatttcttgctcccgcagctctcttcccacaaacgaaaggcttcatctcttcgggatcacgtggtcttggcattacatctcacccacctcccagaacttataattgagtttgtgtttgttttactcttctattgatctactgattttgtattattagaataaaattgcattatctttcaggctctctatatgttttaagtatcttcgtaaatttgtgtcaaatcatcccactgaagccctgttttattaaaatcttcttcagtaatgttgtccccaggaaaaattatctttgattttcaataagggtggccagctttctctctcccctcaagtttaaaagcctaattattatccattggaagtccttaattagggaatgaaggtctaaatttcatcatccttctgagacttagcatttataagattttaatctcgccttgtaacttattcatataattcatggtaaaataaacaaaaatacattcttcggggttaatatgagactaagagatatgaaatacatgctcgacaaatacaatagtcagattgcaattaaagtttccaatagtggtcataaaaaaatgataactggtttacaaaagtctctcaatgctataaacgaattatcttgtttaggctttttagacgatgatattaagagatttgagtctctaggtaatatctatcacttgcgttcacctgaagacaaagtggaagttgaatcgataatttcaacccaaatagttagttacataaatattgtgaaagagaaattaaatggatttattacactaattgataaatctgtgtctaaacaggacaaaaacacagttagtgttaaacttccaaacttcaatacattagatgaactagagaagtttacaaagaagttaaataaagcttttcaaagcgggataactaataaagaaattgatggccaatttaatttacaaggctttgatacaggttccatgtggatggaaatcttagttagtagttcagctgctctactaatattaggaaaaattatagacgcagcacaaaaaattgctataaactcacaacagtatttaaatgcaaaagctctgtatgaaagaacagtattgcaaaacgaacaagtaaaaaaacaaactgaagcttctgatgcttttttagagggccttcaaaaaagtatcaatgccattactgatgccgaaataaaaaatgtaattgaaggatcagattattcagcagaagcaatcggtgaaattaaaaaatcagctgaactatttgctgggctgattaatgagggggctcagttccacccatctttagatgcccctactgaagcagtagaagcttttcccgaatcaccacaaagtttagaggaacctcaaaaactattagaaacactaactgaaatttctcctgaagagtaattcattctatttgaaagctttattcttatgaaataaagctttctattttttattactatcatagtaaaaaaaggtaaccttattcattttcttgccgaataagcactgtcttacgctattcgcatttatttactaatggttcgccgatttccctcaatagataagcaaagataaattgagagctggtttaaagactttcctggcaagcaggatctcaccgctgcgcgtgactatcgcatgcaatactgcataaattccagccgcaccgacctgcctcccattttacaccacggatttttccagattcaacatatgctcaaagtggcaatcttggcataattggctgatcaactcgtctttcattttgcgtacagtttcccgtgaaatgccaaggtgaagacctgttgcacggtagctcattccctccatcatgcaatcataaataatcttgtgctgctcccctttgattttttcggcgcctaactccactgcatatactcgctcttcataatacttaagacgtttgaaaagacgttcctctctcatatccatttgccgcaattcagcctgactcttcccgggacttccttttggcatagcagcttctaatccatattgagcaacaccccaatttttcattggaattactgaaccatagagtactctctgcaatcgatgaacctctttcaccatccagtgatagctattgattagattttcaatttcttttcgatgcatgattgtgtcctccttttccaaataaaaaaacggacaccaaacaaacagcgtgtaagttcagtgtccgcaggctttccgtcttggactagtttaattaatttttcttaattcttgattgtcatttgtccataaaaattttgatttcactaaatggtcatcaaagaaatttttatttaaaatcaaatcagcaaacttctttcctttttctgaataagttatgttatagaaaagcattaatagttcaattgatgatagttgagcccgaagaatgcctctatactttctttgttctaattcattttcttcaatatcatcactaaactttccatcctgtataaactttattatcctataaagatttctaaaataatgtcctattacatcttcattttgactatacattaactcataagcattatttctcaaatcctttaatggagagagcagaaagtctttcttaaattcaagtaaaaagttaattgttatatcatcgaaaaaaaattctttacttattttattactatcttgttctgtgagaacataattaaacattgtttttgttgataataaatattctctacaaacttcttcattattcttcatgtaattttcaaaataattttctgcatcttttttaatctgcaaccaatgcgtatctgtttcattataaattttttcttcagcttcataataacgcgtatcaatttgtatttcgtcatattcatcaatataagaataagcagaaatattgtcttgtaatttctcgaataactcatctctcttttcttttaagaaaagaattttagttatttgatttgttttttgtattttctcactgttaacgagttgatgtattgtctcattaaaaaaatcttgttttattatactgttataaatctgttttaattgtttatattgttgttcaaatacatatcttccagcgaaaactgtttcttttctctctaattttaagtcctttaaaatattgtgatgcagattaatcatattaaaaaatgtattttcaaactgctgtttcaacaaagtttgattagaaagttcgaattcttctctagtcctttttaattcatccctttgcatagttaattcttttctttgcaatgctagttccttcttctgcattgaaatagtcgcgactacaaaaactatactggcaagtgataataacccaacagtggttccacctagaaaatctccaatcggtcctaaagaatcgaatttcttaagatttaaactactatttaatttaattaatagcactgtaggagtcagtacagctacaaaaacaaataaccatcctacaattagccatctattttcacttgattttaaataagtaagtattctttttaacatttaatcactcctgaaataatcataaaaatatcttcgttatgatatagcaagcctcatttaaatcatcgatttcatcaagtatttccataatcaagttgaattttaaaaagaatgtaataatttttctgaatttatgaaacctttgttttttcggctcgtaatacatttatcctaaaaaattggaggtttttagtatgtttaatgaaaatcattatgttccagtattaaggtggaaaagaggtgaacaaaatgcaattaaagaacttgatgacaaaattaaaaataaaattacaccattagtagagatcccgcccatagactgggatttcgagaacgaatgtcctaaaaaaacaattgacgaacatattaagaattttgctagtcaattaaaaaattcttggggcagtactaacactatatttatcgatgcttttcaaatatgtattgatgacgaagaaatgaccgtcaataaaatacacccactgaaacatatttttgattcattattaaaagaaaatttaaatgcaattcctgttatatgtccgaattctggtctgaattatgaaaaggctgttcgtaccattatagagacttatgatacaggatactgcttacgattgtcagataagcatttagataatactgatgaattaataagtactttcttaagaaaattcccagcctctccagaaaaaattgatattattctagattatagatacatcgaccccaatcacacatcacgtatgtcttcattagtcgcgggtacattattaacacttccatatataaatgactggagaacccttacctttataggaacgagcgttccagagaatttatcttcaataccaactggtacagatggaagcattcctagaagcgaatggctcatctacaaaaagttattatcaactaatttatcaagattcccatcattcggtgattatgtaatttctaatcctgaatacatatcaattgatcctcgattgatacaaatggccgcaaatattaggtatacctcaaatgaggattatctattttttagaggacattcagtaagaagtccgaaattcggaaagtggcaacaagctcaaacattatgtaaaagactaattgagcatcatagtttttatggtaaggattactcttatggtgacaattatatatatgaatgtgcacatggaagaaatagtacaggtaatgcagaaacttggaggaaagttggaactaaccaccatttaactttggctagcaatcaactctccagttttcacgattccttagttgctcgttcacaataacctttatctcttccaaagtgaaactattacagatcttttcatataattctgcccgaggtttgcttaagtatcctttttgcaaacctctttctttcaaaatatcgagtgcttcatttctccatagcaagtgagttaatgaaaacgggtctactttcaaattacatctcccttttctaacttcccttaaatttatttgatctttattccttgtaacaagaagaattccccaccattttggaactatttttcggaccgcatgtaaatgatttctctgaacaactattgtcattctgtcaaataccttattatagtcttctatctgacttggcagtcttaataatgtatcgctttcgcttttaatttcaaatccatgaagcataccattaatcacagctatatctactctagattgtccatgaagaacacctaattcattgattatttttatattttcatcatcggaaaatttattaagcaaatgagttaacaaaacttcccggatatcactatctctaagtttccgcaatgtctttcaccctttttaacgtatcaaggtaaataataacacagaacccacttatttaaagaagaagaatttgattttatattctatcaaggtttacaaacactacacattttaaagttgaatctccagaatcatttcactttaaaccctatctcatgatcaacccgcgcaaaactgccctttacagtttgaataacagtcttaccgtgctccggtgcttctaagacatgtgcagaaccttgattcccatctaaaacaatgattttaaccttccctgggtcaattttctgctgaatagtgaagtcttttttgacgttaatttctcttggattgtacactcaaagcgcccctgtgttatgatatatgtaccagttcatatcaagaacactgaggctaagcgcttcggtgttttttatttttaggcagaaacctctcttatcaagacttccaccctcggctcttcgctataaaacttactgactttcaaatccacaacctgactatcatctttgtatatcagatgattcaaagcatctttcacgccctttacataattatcaacgtcgggctttgtagtcggccgcagaagacccttttcagctttttctttcttctttgatgagtttgaaactgattttggcataggtctgtacactttgacatccattgcgacagggccattaataatgttcttcggacgatgctgagacgcaaccaaagctacatactgcttgaaatactttgatttcgctggatctcgcatatgcaccttcccatttcgtattgatccacgcggtcgtccttgtgcgactggctcaccataaacagtgaacttaatgcaatccaactgttctttacctcccgtcaagctgttcccatagctgaatttctttttctatcctcggtgccgaaattaaaactgccagcagagacacaactgctttaagcactaagcacccgctccatttgctttattttttcctcaagtaaacggattgttggtgtaagatctttacctttatttcgatctgaaggtccaaacatataaagtccaccagttgcttttacattcattttctccttcattcacaatcacctaacctatgatttaattgcattcgatcgcctctaataatcactatgtaatcacggcacatctggtgaattcgtgaaccaagagcctcgtctatatccaaaatctcatcgattgttaactccgaagaaatcagcaaaggtttgtgatttaaataccgatagttcaagactgactggatttgttcaacctgccaatcggttgcccttggctgcccgtttattggtttgaataagtcatcaatgaataggacttcgacctttctcatgacatcgagttttacaactaagttgtcaagttatgccagcaatacttatgataatcttctggaatcatggtacttgcaaggaaagaaaaaaagagctcttaaatccgtttaaatctaaacacaaaagaaccgcaactggcggttcttttagtatatattcctatttgacttcattattattggacagtaccataatcaaaatcaatatctttcttgtctaaatttcccttaaaatttttagcataggtcatggttaaatgtacgcttttatttatccaccaagttccatcatcagtattagtatcccaagtaacatctatatctcttcccaaattctcaaaaaacaccaaatttccaacagctactgtttttccgttgattttgtaatatattagaacaattttcttgtcaaatatacctgtcccgtgctttacgattgttaaactataaggcttattaggacatttctcttcaagtataacttcaggatttaaaaataaaacataacaaatgaataaaattggtacaatcgttaacctttttaataattttttattgatatttaaccccttcaacatagccctccctttttaacaatccatttcatttgggatacacccccatcattgaacgtatttcctatgaaaaatgattttgaacctcataggaacccttacatgacagggtttgtgttgttttttcattgtttatcaagacctaaatcaaaaaaagccataaaaaataaggagtgatacatattatacatgactaatatgtatcactcctttaatttttgttcaataatcgcgcccgattgtggaagatcgttattgaactaaagccctcgatagttggataagaaaaaacaaaagaacttgctatttctcaaatacatcaaccaaatgttcaatgttagtttgtttttcatacatactaataataaaagtaaaaccttattaaaactttacaagacaaactgaattgactatagtctaattagactaaaatattgatgtaaagaagtgaaaaattagatgataaagtctttttttatgttggggcagtcgaatatggcgggccgtggatttttgaatgaagtagaccctatctataatgaaaaaataaaaatgctgcgcaatggacagtggcagatgatgacagagccgattaattacgaccgtccggtttccggtgttggcctggcggcatcttttgcagatgcatggtcgaaagctcatcccgatgaagaaattggcttgatcccttgtgctgaaggtggcagttcattgaatgactggcatccggaaggcaccctttttcagcatgctttgtccgaagcccgcttcgccctccgatccagtcaaatttgtggaatcctttggcaccaaggtgagagtgacagttatcgttcgctacatgaaacttattacgagaaattaactcttatcatcgagacgctaagaaacgagttggagcttgatgaggtaccgttgattattggagggcttggtgactttcttgggaagaccggttttggacagcacgcgactgaatttcgacaggttaatgaacaattgctgcgttttgctaatgaacaacagaattgttattttgttactgcagcaggtttgactgcgaatcctgatggcattcatttagacgcagcttcacaacgcaaattcggttaccgctatttcgaggctttttcgaaaaatcaccatatcctgaaacccatttcgggagaggagcaatcactgaaagtgaatggtgactattctaaaacagaacagatttatcttcatagtatggatttagcttcgggtaaaatcacgtacgcggaatttgaggcgcggatggcgaagatgatgaaaccatgattcccttacttatccttggcttgctaatccaaaaccccggagctcacggctatgaacttctggccttaatggaaaaacgtcattacaaatacattgttaacttcacgaaaggttctttttattacaatctgcagcaacttgaagaaaagtgttttattgaacagattcagcagaaaccctcaaccagcgggcgtgaaatccgtaactttaaagtcacagaatcgggaagggcagaattcgaaaaattaatgatcaaatacggcaccaaatcggaatatgtgaacctgcaattttatggggcgttactctttgccgatgaattcgacaaaaataaattactggatctgatccaatcacaaatcgatcagactaaagctcgaatcgagctccttgatgaatacctgtccattactcaagaaattcccggcacaatcaattactttcgccgtatgaacgaaaattcccgttcacatcacttgattaatttagagtggttcgaaaaattgaaagcagaaatagagtgaactattgcataataaaaaaatgtaatgttagatatataagaatattagttagctaaatataaaacctgtgtcgtagatatctagtaacatcattgatacaggttttatactccttctttaattaaaccagtaataggattgtcaacacttgcccccaacaagagcaagtgaatcagctgcgtattcttcttttttcaatccttcgtattaataaccactttttacacctatttagtattcaagtaagtcaactgatttttctccttcttccgctaaactgctgcttagtcgaataagaaaaagtgatctcccttaaagaggaatcacttcctctaattgaacaagcagtgaaggtgaacatttttgaattggatgtcaatggggaagcaccaaaaataaccgaatttcgcatgctaaagcaaaatttcatttcataaagaaaaaaccgatgttcctatatatgcgggacatcggtttttgttcgtatccttctacttaaaagtaataaaattacctatactaactagtaaagggttcatactatacattttaaaatatcaattaagcactaatatttgggttatgcgccgtttcacctttatgggaaacataactatgtgctatcattcctagcattattacaaacataccacaccaagataaaatagaaggaaatgaagaatgtaataaaattagttctccgataacagcaaaaagtacctccatggattgtgttgcttcaacagttgcaagtttctgcatatctcctttaaccatatcagtcgctttaaaaaataagatagttgcaattacacccgaacaaatagcaactaaaatagattgcatagtttgctctttactaggcaatccttctgtaaaaagaccatacaaggatagtaaaaaccaaaatggtaagctagctaatgtcattccaaggacacgttgataagcatctagacgatttccacaaacttccatcatcttacgattcccgagcgggtaagcgaaagatgctacaataacagggataatacctaacaaaatatcttttacagcaagcgattttgcttgttccatttgcatgaagaaaataccaagaagaataattaatgacatacccatacctttcattgggatttttcctcttttcttaagaattccatctggtgtttcaatggtttgaaaaaaaagaggagctaacaatgatcctgatataatagtaatttgccatgtcccagcaattatccatcctggtgcatgtacagcggcaaagcataatggagcgtaaaatagaccaaaacctacgaaactccataaaaaccatgctcttaaattctctctcataacttgtaataatacttttaattttttcctactcataacaagaagtaaaagaaatggaagcatgaaaacaaatcgtaatgaggcactccatatccagctaccacctgataattccattgctcgattcaatataaatgtgaaagcaaaaaagaaagcagcacatatacctaaaaaaatagggcgtaaatttctcacctcaatctgtctcataagtcagtaattccccagacttaaccagttttgttctacaagatgtgctgttgtttctttatctttatttttgcatgcttctataatgtgctgatgttgttctactgatttcaaaccattcatagaagtgaactgagaaatttcaaggcgttgaatcttagatatacttcgttctagcgcgcgaatgatttcaggatttcccgccacatctagaaaaacattgtggaatagctcatcggcttcaattgcttttataatatcttttttctcaatagatagtagtaaggctttattactgaactctaattcttgaatatctgcctctttgagtaatggtactgctaaacgagctgctaatgaatgtaaagctgctaccacagtaaatgcgtgttttgcctcctcaagatttaatggtgcaacgcgagtcactgaaccaggaatagattcaaccagtccttcatcttcaagacgttttagagcctctctaaccggagtacggctaattccgaattcttctgctaactctttgtcatttaagcgttgctccggttgcagttctaatgtaacaattgcttttttcaaagttagatatacttcatctcttaatgacgtacgtttaatgggtttaataatatcttttttcataaaaccaatatatcggatattggttttatggtcaactgtaattttttcaatcagatacattcaattagcaagttctaaaaacgactgtttatggtacttggttattttaaacaaaggctctaaaaattcatccattttaagtaccaaaaccccgctgcaatgatggcgatgggaactaacattggtctaaataaaatggctgatgctactcctggtatctcctacgaaaataagagatataccatatatccaaatctgttgtttttctaatttttctctagttatcttcatagtactatagtcaagacttgtccaagtcacctttatcaaaaagaatttcatcaagcacttgaaacatttattgaacgtgagcaagtgttataacattaataagaaaccaacgagtgatgaatcttttaatctttcattttaccagctgactcatatcaaagaagctctaaccaaattttaatagctgtcgcacctattaattgcgctaaaacccattgcaggaattttgtatttactttttgcccaactgatgcaccaataggagatgcaattaaactagcaatcataagaaccagagctggtacaaaaagaacctggcccgtgattacttttccaactgttgcgccaatagatgaaagaaatgtaatcgcaagagatgaagcgactgtgattctaacaggaatatttaaaatcgataacataatggggaccaggataaaggcgccgccagctcctaaaatacctgatacaccacctatgattaacgctagggacgaagccaaccatttattaaatatcacttctttgtcttcgctatgttcttgtccttttttaggtatcaacattaaaataactgctaaaatagccagaattccgtatataaagttaattcctttttcagatatgtaatgagaaaagtaactccccaatacactccctaaaaggatgctgcttcccatgtaaataattaatgctttatttagaagaccactcttacgataagcccaaacaccgccgagtgtcgcaaagaaaacttgaatagcccctatccctgaaacttcatgggcagttaatgacatcactcccactaaagaaggaatgtacaatagcattggataattaataactgctccgccaataccaatcattccggaaataaaggcaccaataaaccctataatgaaaagagttgtgataaaggcaatatccactttggtttcctcctttcaaaggaaaagggtatctttttattcgataccctttcacattattagccttttttaatccagaatttcaatacatcaccttcatcagtttgctctaaaaggtcatgcccgcctgatttagaccaagctgcaagatcacttttagctcccttatctgttgcatgcacttctaatatttgacctgattccagttcattcatcgctttttttgtcctgacgattggcattgggcatgccaggccttttgcgtctaatactttatctgatttcatgttcatctctcctctttttaatagaacttgtgttaccgtattgcacagcggtttgggccaatctccatttcacgctgtttttcttcatctgggctgattttccccatgtttgtttctcgaatctcttggtatgcatttggttgcggaggcaaatgatctgttactaggtgtctaaattctgtttcatccgcaatgttcaaaccatggttctcgctaaataatgtacttagttttttaccaacacttccatcctcatttagctcgtcaatgatcataaagtgtgctggtaatacaattaaatcctttgataacgctttgtaacggctataaagcgtttttcttaaatctcctacccaatcttctgccataccggctaagtctggtctgccaattgaatcaataaacaaaatatcacctgaaagaagatacagatcatcgacaatgaaagaagtggacccaatcgtgtgccccggcgaataaatcggttgaattttaatctttgtatttccaatgatcatgtcgtttccttcttccaacggctgataatcgaataccacttcttcagcatctttaggcggtaaccagtaggttgcttttgttttttcagcaatgactctgccgcctgaaatatggtccgcgtgaagatgtgtatcaaatacgtgagtaatcgttgcactcttctccttcgcaaaatccataaagaaatctaccatacgtgtcgcatcaataattgctgcttcaccattggaaatgaccatgtatgacaggcagcctttaccgattcgaacaaactgatacatctcaccgccatcttttaaatccccgacttttaccggctctaaatgttcgctccatgctttcattccacccttaagataggatacagaatgacctgcttcagatagcatttcggataccatgacggatgaaccttcttttgcacaaacgaccagcacttctttatcagaaggaattttctccaagatatcttctacgccatctaaaagatcgaaatacggtatatttaaatagtcaaagtcatgtccttctatcttccaatcgctaaaatcattttcattacgcacatccaaaataaataaaggttctttgttaaagattttttttgtcacttcttttgggatcattgcctttacggtcatgtttcaatacctcctatatcgaatcttttagcgggactaaaatgttaaggatacatcagcatctttagtaaaatctaaaaaggtaacagccccgcctacttcgattccttccataaaatcatcttttgttaaacccataacgtccatcgttatttgacaaccaattcatgcaactcccatttcaatcagttaagaatagaaggcacatttgctttcttacaaccttctgcgaagtgttcttttcctttcggcatttctaaatgttgatgggaatgcttatggatcaggtttaatccctcgaatgtaaagaagatagatacttcttgatcacttgctgctgccgcagtcgcaatattaaattaaatactttataagcgtcaaacagaccaccatttgccgcaataatcgctactcttgtacttatctgttcatcatcctttttgtttattctgttttacctgtccaatcccgcataccgggaacaacattaataacctttttaaaaccttgttttttcatagtgcgggccgccatttcacttcttcttcccgaatggcagataatataaatttcatcattttcgtttaattcgttagagcgcttttccacttcaccaagagggatatgcacaactccagggatatgagctttttcatactcctctatctctcgtacatctaaaatgttaagagactcgccactatccactttctgtttgaaagcttctaatgaaatctcaggaattgaagatgcattttctgataaatgctctcctccttttcgaagaaaatgacgaagtatttctccctctgcttcagtacctagatattcatggcctgtactttttgcccatgcttccagatctgctgtagaacctttatctgttgcatgaatttccaatacttcaccagcttttaaatccttcattctcttcttcgtttttacgataggcattggacacgccaaacctttagcgtctagtacaatatttgctttcatcattttttcctccttttctcatataggggtgggggtatataaatatacaaaaagtttctccctagaagttaataccatgtattcatacccccttttatatttgtgatctttttaaatccttgtttcttcaatattttacttgcctttaaacttctcattccgcttagcaatgagtaacattagataaataagttgacactgccttcctcagcatcagccaaataggctgctacaccagcatagtcgatatcatctaatagttctttttcctgtaaaccaagaagatccattgtcatcgtacaagctacgagctttaccccctgttcttgagccatctcaatcaactgaggtaatgtaagtgcattatgctttttcatcacatttttaatcattttagggcccatacctgcaaagttcattttagataaacccatcttatcagcaccacgaggcatcatctttccaaacattttttcaagaaatccttttttcactggaatcagctcttctttacgtaaagcgtttaatccccaaaaagtatggaagatcgtcacttcatgatcataggcagctgcaccatttgcaataatataggctgccattgctttatcataatccccgctaaataaaacaattgttgtgcgttttgtttgttctgtcatgttgattctcctaactaattacccctatgggtatattaaagtcaaaaaattttttcgaaagatctgctattattcaactctttaaataccggttggggtataatataacgcatataaaaattcgtcaaccttaggttgatgaatttttatcggctctttaccaataagtcgactgcttcttttactaaattttgtgtgtcttcgcctttttctaaactttcacgaacacaatgttcaaggtttgtgctcacaattaaacccatcgctcgatcgatcgcattacgggaagctgctaattgagtcacaacctctctacaatcttttccttgttccatcatagtcaatacacctttaatttgtccttcaatccgtcgtaagcggtttttaatcttttgatcatactccatatatcaatgaaatcctttctttcatttatttttacatttacatgttgccagttcataactgtttacatggatacctttgcgctttagaaaacgcactcctaaatttaattccacccgatcacgagctattatgtgtattttatcacgtggaatctctaaataaaaacgttttagatacgcatatgggatgtttaaaataatatcatccgaaaaattgggtacatcgttataatggcgaatatctaatattgtcatgtctatagcctttaatttatctttatggatacaagagattccggttataggataataacgtctatacgttgcaatgataatcacaaaaataagcaggaatgcaataactaaataattgatactacttacaccaccttattaactctttgttattcacaaaactataatatacccccataggtatatagtcaagtgtgaaagtcactttctttgtgctgatagattcatttcaatatccgcgaattgaaaaaatacttacatttcgataatgccaattctgctaaaagtaacttgaataaagaaataagccgattttaatttaaatcgactttattttatcaattacttttaaaattagcacaagactgcttggatattacattgggtttcatttgcataaaaacaattcttaggtactggttccccatgtttcatgctggatgtgattctgcgaataactatgctaatcttccgcagccactgcatctgctttggttttatgaactgtaccaaatggatggttaggaggagcataaatggagtaaagttttaatggcgtattacctgtattaatcacgttatgccaagtgccggcaggtacaacaatggcagaatcatcataaacatttctttgaaagttcaaatgatctttgctctttcccattttgacgaccccacgcccctgctcaatccgtaagaactggtcaacgttaggatggatttccaaaccaatgtcttctccaataccaagactcatcaaagtaacttgaaaatgctttcctgtccataaagcagtacggaacgtattgttttgttttgtggctctattgatatttacaacaaatggttttggtccataatcctttaaaagaagatttctatcttcatatgaagagcgcaaatcggcacctctgtgtacgttctccatctcatttggaatagtccaataaacagatcttccatcattatacatcggtacagtcacataataataacattgaggcgaaaaagggttatagtacattttttgatccccacaattataaatttttgtgatagtatcctatgcatttattaagggagtgtgctaaatcaagaaaactcatattaaacacaaaaatgaatgttcgatcaccgtttgattcacgaattaataatttatcaccgaccttgtaatcgttttctggatgttgaatttcactagcctttgttaacaagacatcgaatgacacttttatatgatggattatcaaaggtcgacgatcctaaatggcttttgaacatttacatagcacaacaacagagtatacggaattctgttgtttgtcccccctatcccagctcttttagatttatccctttggatgcgccttgatggccagcttttcagcagcgtagtatttagcgcctcctgaatcgttatagcatatttcaacgccgataaacttgcggttcccagtgccgtttgtaccgtcacctgtatgtgggctcgcttttagtaaaccagtttatattcttttgataatcttacacctctttaacttgaaggaggatttttgcatatgtattttcatacccgtcaactaccatctcatccagcatatattcctcatatgcattttcccctatttgcattccattcttttcaatgaactcaatgattctccggtacgcctcttcagtatttccgcctatttcatatccaactgcatacaggccttttggccgtacatgataatttatgttctctcccccattttttacttttatataaaagtaactgtaattgtagaagtctttttctaagatttgttcccgtgcaaagattccgcctatcggatatccttcatctaattcattttgctgaacttcatgaatgagttctgaaatggctgccacatattttcgttccggtaagtttaatgtttttcggcttaacatgaatgtttcttcatttaaatattcaaaagaaattgaggaaaaatcagtctcaagtgcttgttcagtaagcgccacttttgtttgtaagatcgtttgcaactgcttaagctcatttatttttttatcaatctcaatagacttttcttttagaacatgcaggatcttgtctggtgtttttccttttattagacactttatttcttttaatggaaccccaagctctttaaatagactgatgacttgaaaaatctcaaattgatgataggaataatatctatacccattttctttttttatttccggcgagaaaagaccaatctcatcataatgaaataaggtttgtttttttacacggcagagcttcgaaaactcccctgttgtgaaatacttcttaacatcttcgctcataaaaacctccttgactatacggtaaccatataccttatgatttgattgtacttgaaaaaagcttcaagcgaaaaggataggtaaaaagggttcaattgagtaaaaggggaattcagatgaaaaaatcaataaatgagcaaaaaacgatattcattatactattaagcaacatcttcgtagcatttcttggtatcggtttaatcattccagttatgccttcttttatgaaaatcatgcatttatctggcagcacaatgggttatcttgttgcggcttttgccatttctcagttaattacttcaccttttgcaggtaggtgggttgaccgtttcgggagaaaaaaaatgattattctcgggctgcttatattcagtttatctgagttgattttcggattagggacccatgtttcaatattttatttctcgaggatattgggtggtataagtgcggcttttatcatgcccgcggtaacagcatatgtagctgatattacaaccctaaaggaaaggtcaaaggcaatggggtatgtttctgctgcaattagcacaggctttattattgggcctggtgcgggaggatttattgccggctttggcatccgcatgccgtttttcttcgcctccgccatcgcgttaatagcagctgtcacttccgtttttatactaaaagagtcattgccgatagaagaacgccatcaactctcatctcatacaaaggaatcaaatttcattaaagacttgaaaagatccattcatcctgtctatttcattgcatttattatcgtctttgtaatggcttttggtttatcagcttatgaaacggtattcagcttgttttctgatcataaatttggctttacaccaaaagatatcgcaaccattattacgattagttccattgttgcggtagttattcaagttttactattcgggaaattggtcaacaaacttggagagaaaagaatgattcagctgtgcttaataaccggagcgatcttggctttcgtgtctactgttatgtcaggatttttaactgttttgcttgtaacttgttttatttttctggcgttcgatttgctacgtccggccttaacaactcatttatccaatatggccggtaaccagcagggtttcgtagcaggcatgaactccacatacaccagcctgggaaatatatttggacctgctttaggcggtatactatttgatcttaacattcattatcctttcctttttgcaggtttcgttatgattgtcggccttggtcttacaatggtttggaaagaaaaaaagaatgatgctgcagctttgaattaattcagcctctataaagtcaagtcatttagatgcagggaatgcctctggttaggcacaataagaaaaggtacttaatttgataggctacatgttgcttgacgtgaatatagtttaagctgagttttagcaatatcaggatttcatctgccatcaccttaagccgcagcctaaccgggataagaaaaaaggagaatgtagtatgagtataaaaataaaagcagtaactgatgataatcgtgctgcaattcttgatctacatgtcagccagaatcaattatcatatattgaatctacaaaaatatgtttagaggatgcaaacgaatgtcactattataaacctgtcgggctttactatgaaggagatctagtcggttttgcaatgtatggattgtttcccgagtatgatgaagataataaaaacggacgagtctggcttgaccgattttttattgacgaacgctatcagggaaaaggattagggaagaaaatgcttaaagccctcattcagcaccttgctgagctatataaatgcaaaagaatttatttaagtatatttgaaaataatattcatgctatacgcctttatcaaaggtttggttttcaatttaatggtgaactcgactttaatggtgagaaggtaatggtaaaagagctatagatatccaggcctccttttttgcttagaaacgtttgaacttcgatcatgattacctacttaaactgcaagatcattgtttaaaaaagcctggatgaaaatttcatctcaggctttaagcatcttattagtcaaaatctcatgtgttttatccagatgttattcttttttccggacaatttctaaataattaatatgccggccaactgttttgtgcactttaaaaatatacccatcggcttctataacggacccaactgcagcgtctatttgttgagtcataaaccagccgcctattgtatccacttcgtcacttgctaacgtcgttcccaataaattatttacatcttcaatgagcactttcgaatctaagatatagtgattatcatttacttttctaatattaggcacttcatctttatcaaattcatctctgatttccccgacaatttcttcaagaatatcttcagcagtgactaaacctgaagtgccgccatattcatccacaagaatagcgatatgtgttcgctctttttgcatttttaccaataaatcatgaattggaacggattcaataacatggataacagggttgatatgattttctaacttgaaatcctcttttatcttctggtctgtgtcaatataagctgacaaaaattctttagcattgataaaaccaatgattgaatctttatctccatttaggactgggtaccttgtatagctctctgtcttaatggtcttaacaatagtttcataagaatcctcactagaaatcgctacgatctctcttcttggaatcataatttctttggcgattctttcatcaaattcaaaaatattatttacatatttcaactcatttttattgatttcaccgctcttatagctttcagacagtaagatgcgcagttcttcttcagaatgagcaagttcatgttctgatgcaggtttcaaaccgaaaagtcctactataaaccgggctgaaccatttaaaaaccatataaaagggaacaggatgcggtaaaaccaaataattggctttgcagtcaaaagagtgatggtttccgctttttggatagcgagtgttttaggagcaagctctccaactacaacgtgcaaaaaagtcgccatcacaaaagcaatcactaagatcaatacatgtgagactgtttcacttacatgaaaatgagcaaataaggggtgcagaatcacttcaaaagtcgattctccgacccagccaattcccaacgctgtaaccgtgatccctaattgacaagctgacaaatattcgtccaaatgagtaatgacctttttggctgatacggcacctttttttccctctaatatgagttggtcaatttttgatgacctgatctttactatcgcaaattcagtcgcaacaaaaaatgctgttaagacaattaaaagagtaaagattataaggttaatggttgtcaatgatttgccttacctagtaaggcgtacacctccgatgtaaatattttcttttatttttataacattcgttttttctgaataaacaaaaaacaatatatataacattataagttcaaaagaacctaaaatcaactctgaatgatgtaaataatcatctttttccgtatgaagagtggttcccatagtattcaactagcgattggtgacattttaagacttaaaatagaaagcaaaataaaaacacacctgaattttctggtgtgtttcaataatatccaaccgtcttgatttatttaatgtctttattaaggttttcttttaaaatttgaatcaattccgcctgttgctttatatttttgcggccatttctattaattgcagcaagttcacagacaattccagctgaaatgaaaaacaataaaccttcaaacattttaaatcccccaccgtctaagtgatagtcaaatttgttttttcttttttcaatacctgcttataatcttccttacgctgatatatgttatttaaaatgagtccaataatgacaaacagtgttcctactatatcaaatgcagttatgttatatcctttgatcaccatgattaacaatgtagtaatggggacaaagttaataaataaaatcccattaatggatgataggattttaatgccatagttccaactaaggagggctatgatacctggtaaagtaatcataaataaaaaatcatacttaattgctgcaatcactttaatactcggtaccgacacgtaaccttgcgcggtaagtatagctgtcatgattcctgttatagctgtgccgaataaacatgtcaaagttgaataacgaagtgtggaccactctcggaatatctgtccccccattgtgtagacaacccaccctaaaacaccaatgaatataaagagtatcgagaatagatgatcccctaatgaaaaaaagaaacttatattacctttggttatgaccatcgaagcccccaaaaaggcaatcaatatactgatcattgtgtattttttaggtttcacatgtttatatccccatagaataacaattgaaagcatcggcatgagtgcctcggcaatggatgctgtcataattccagacttccccatcaacctttgacctaaaaaaataagaacattgtatatagtaaacgccatcaccccaaataaaatgatccattttgctttaccctctaaatgaaatgatttttttccttctctcactaataataaaatcactaacataattgttaccacaccgtagcgaataaatgaaaaataaaacggatcaataaattctaatgcatgatctgcaactggaaacatcgcgccccaagacatacttgccactaaacatgtaagggcaccaatgaataattgactttttttcattgaattcccctccttttctttaaaattacaatgagaattataaaaagaagtaagcatcaagtaaaatgaacaaaagtgatgaaaaacatcattgataatgatactttaatgaaggggggatcttcatggaactgcgagacttacaaattttcaaatgcgtagcccatcacaagagtattaccggtgctgcaaaagagttaaattatgtacaatctaatgtaactgcgcggattaagcaattagagaatgagctcaaaacacctcttttcaatcgccataaaaaaggggtttcactaagcccagagggccgaaaaatgattgaatacgttaacaaaattttgaaagatgttgaagaactggagcaggtctttctagatactgaaataccatctggaatattaaaaatcggtacagtggaaacagtgaggatactgccgaccatcatagcttcctattataaaaagtatcctaatgtggatttatcattgcaggctggtctaacagaggaacttattaaaaaggtcatgaatcacgaattagacggagcttttatttcaggccctttgaaacattctattctggaacagtatgatgtttatactgaaaaacttactcttgtaaccagtaacaaaacgtttaatatagaggatgtttcaacgactccgattcttgtttttaatcaggggtgcgggtatcggtctaggcttgaacaatggctcaaagatgaaggtgtgctcccaaacagaatgatggaatttaacatcctggagacaatcttaaatagtgttgcacttggactcggtataacagtggtaccggaatctgctgttatgcatctagctgcacaaggtaaggtttattgtcacccattacctgagaaagatagctgtatctcaacaatctttatacgccataaagatgcgtacctgacaaattcaatgcgcagcctccttaagaccattgttgaacataaaaatatgagtatgtcttaaagtgatttttctctttctatattctaacttcttaaataaaagagaaggcgcatctccacttcgctacccttattcacaataaaatagagcagtaaacatgtgagttactgctctgcttcgtttattcaccgttcatttgttttacaatgtattcagcatcatttcctacgccttgaagcaatgctgaacctcgcttatgctgccaaggcaaccctataaagtacaatccttctacaggtgaaacacctctatgatgtatgattcgaccttcttgatccaaaacaccttttatatttatccaacataagggattcctgaaaccagtagcccaaataatattgtttacttctaatgtagatgaatctttaaaaatgatttcattttgctttgcggcaatgactcttttttttaagatgatctccttctgttttattgcatgttttaattcatgcccaaatactggatcacctttcttttgaatgaatttgcctactattgatgtatgacttgcatgtaaaactcctaatttatcaaaccaccaaaagatgcttctttttccgatcattaaagggaaataaactagtttattactacaggctaaatatgtaactctttctttggataattcaacagctatctgagcaccactattcccaccaccaactactagtacatttccatatgccaattgttttgaattcttatattgtgatgagtgtagctgattaatatgatcagctaaatcctttgatattgatggaatactaggggtatgaaaaggccctgtagcaatgacaagattcttcgtttgatattcttcccgatttgtttttattaagaaataattctttatttttaggacacttattacttctgtccgtaattggattggaatttcaaattttttaacatacttctttagataagcaacaatttcattttttgtaggaaatccatgtttttctccttcaagatgcattccaggcaaagagctatacattcgagaagtaaataaaactaatgagtcataccgatctttccagctctcccccacctcatgacttttatccaaaatgataaacttttgatcggactgcttaagataatatcctatcgagatccctgcttgaccagccccgattacgatagtgtcgtacacattatcaccccgccaatttcaaattgtcagtagacagaatctgcaaaatgctagttgatctcctcactataaagttagataaaaaatttaatggtgatggtggtcacgcggcttctccattttgggctgacaaaggatcgcattgtcgtgattatgcgcttcggtttccatttgaatggttacgtgcgtaatgcctttatgctcaagttcatgttcaattttgcgtaaaatattttcactttctgaaatggtcagttgatcgtccacaactgcatggcaagaaagagcattcaatccgcttgtgatagaccatatgtgtaaatcatgaatgttttgaattccctctgtcccttcaattgtacgaatgatatcagagacatcgatattttctggagttccttccattaagatgtgaatggaatctttagtcacattgtaaccgcttcttagaacaagaatagccacaatgatactagccaatggatctgcccagccccatccaaagaagatgataagtaaggcagctaaaatggcacctacagagccgagcatatcgcttattacatgtaaataagctcctcttatattcagattattctttgtatctccgccactcatcataatccaagcgaccaatagattcacaactaacccgatgatactaattgtaagcatgccggttgttgctacttctggtggattagagaagcgttcgattgcttcataaatgatataaagagaaataagaattaaggcagcaccgtttatcacagctgcaagaatctcaaatcgtttatagccgaatgtcttattgtgatttgcctttttttcagctaatgtaaaagcaatcagggcaaccattaatgaaattgaatcactcagcatatggcctgcatcagataaaagcgccagactatttgttaaaaatccacctatagcttctataatcatataacctgtaatcatgataaaagagatcaataaaacctttttatttgctccttcattatgattgtgacccataaaaaactcctccttaactaaagtttttgatacatatgtatttattatttcaaatctgttatgaagcattctaacatgatgcaaataatatttatatatgagcatgtgttcatatataaatatatatgctctttactaaaatgtcaaaatatttttatagaaatccacaatacctccttaattattctcttataaacataaaaaagcggagcaaacccatggtttgctccgctaccctagtttctctatccttttcttcaatcaagcatttgagggtagtattcaactacaatttacctgttgaaaattgggcctcaccaagtccaaaactccagtcagcattatcattttcaacaatagatacaattaaatcagttgatgcgataccacactcagattccagtctttcggctaacagcctgtaaaatttttgtttcttctcttccggtcgggatttacttgtaactgaaagtgaacttaagccggtaaatttagaaaatttcgtgcagaatgaaggaactcttgatcaattaccggatgttcttcctaccttacgaagaggcgaagcaagaggaaggatgattgtaaatttggttgaacacatttaataagcaatgcaaccggcgaacaagcactttgtccttcctgcagatctgagtgatattgctgttgattgatcaacttgtttttgttcggaatatactcagtatatagccgcatattcccctgcaatagctggaatgagccaccccagccctatgttatacataggaagaatctgagtgaaaatacgattcacaacttcaatttgtattccagcctccttcaaaccgtcaaataggctgatgatgaatgcgaataataaactgccttgatacacttctgtcttccctttaaatacagaatgcaaaaacgttaaaaatattaaggaaatcgcgataggatacattgtcagtaagacaggcattgacaccttaatgagctgggttaatcctatatttgcgacaagcgtactaaacactgataaaacgacagcaatttttttataagaaatgttcggaaataattcatgaaaaaatgaagaacacgcagtgatcagtccgacacttgtcgtcagacacgccactgtaatcattaagcccaataagattgaaccataagaaccaaaataataggatgaaaccttagccaaaacctctgctccattttctaaaatccccagttcttcaacgctggaagcccccatataggaaagggctgtatacataactgctaagagtacagctgcaatcgcggctgcttttgcacaaacacccatcagctgttttttggtagaagctccttgttctttcaatgcattcacgatgataattccaaaaacaaatgctacaagggcatccagagtgaggtatccttcctgaaatcctttaaaaaacgcttgtgatgtgtacccttttgatggtgcttgaatggttccaattgggcgaataagagctaccactacaagcaatccgataaatgtcagcttaattggcgtcaaaaatttcccaactatatcaatgatttttgaaggattgagtgataacaagcatgccaatgcgaaaaataatattgtaaatatgattaatgagacagggcatgcatcatttgataaaaaaggttttaccccaatttcaaacgatacgtttcctgatctcgggatagcgaaaaaaggcccgattgccaaatagagaatcgtcgtaaatacaatgccaaacaccgggtgaacacggctggctaacgactgtaagttttgtttacccgaaaaaacaaatgctgttatagccagtaatggcaatccaactccggtcactaagaaacctgcattagcgatccatacattttttccagccatttgaccaagcataggcggaaaaatgagatttcctgctccaaaaaacaatgcaaatagcattaatcctataatgatgatataggaagcagacactttttttgacattatatagcctccgattaaagtagacacttcttgaatagccaggaaacattacagatgctatttgcactggcgcagtgttgattccaaaataagtttggtcagttttatatatttttatcaagttcaataaaagcatgatcattttgatcgtttccgatatcggttaaaaaaccaattgcaccaaaaccatataaacaacggttccccccgctatggaaagaagcatatttttcttccacaagtgaagcagtacaactgcagctgccccaaccaattcaggaatgccatgacttccagaaagcagactcacatcttttaaacaataaatgaccaaaagcccgattaccgctgatggcagcactttaccaagatactgtacatatttcggtgtcggtttgccagacgggaaaatcatgaatggaaggaaccgtgtcagcattgttccaagcacgaccattgcaatggtgatcatttgctgcgtcatcgtcatcgtcatacggaaacctcagctttctccaatggttttctcagaacagtcagtacccctaaaatggcgagcatagcaggaataataaattggtttccgccaaaaaggataagacaggctactgaaagtccaagtcctgtgagagcactgtaatgctttttttctttcatccattgttctatgaatatcacaataaacagagcagtcatcacaaaatcaagcccttcggtattaaatttcacgtacgacccaaaaatacctcctatcgctgcccccgcgacccaatataaatgattaagcagtgtcacaaaaaacataaaccagcccttgtcaacattcgccggaacattagcggtataattgatagaaaatgattcatcgcacattccgaaaatcagatagagctttttctttccagtccctctgtacttatccaacatggaaattccataaaacaaatgccgggcattgaccattaacgtcaaaaaaagagcattcatagggttgaacgcaccaagtaaaaaattcgctgcaacaaactccattgagcccgcaaatatcataaaactcatgatgattggatagattgcgctaaatcccaaagaatgcataaagattccataagctatccccaaaaataaaaaccccgcaaaaatcggaattgtatatgggaatgcagaacgaaatgcagcccatatttgacctctcttattcatatgagtgtttatagcaggagagcttaaatgtaacgattctttatttttattcaaatcaacaacctcctacatttcatcaattggcacactgacagttcttttttctgtactcatgactatgcttgtgtcaactccactaatagcagggttctgcattaatgaatcaatgataaaattccgataactctccatgtccttcgccacaatcttaagcatatagtcatggcttcctgtaagtgtgtagcattcttgaacctgtgggaatttgtttatatcctctaaaaatgaatgaattgtctccctatttaagggtgataagttgatgagagctagtgctgtgacttcgattccaagttttttctcatcaacaatagtcgtaaactttttaattatacctgcttctactaggttctttgttcttgcaaggcaagctgatggtgaaagcccaattttcttagataaatttaaatttgatattgaagcatcttcctgcaattctcttaaaatggccttatcagtttcgtcaagcataatacccatttcataaccccccaatacccttaacagaattatatttcatccaatttaaataataacgaatttttattcagatatcaaatattatttaaatttaaatccttttaaaatattatttacagaataaaattatccttgatattaactcataattaaattaacttacatcagaaagaagtcatgggagagttatgtacttgtgtgacttgataccaacatcataagaaacttatcagaagccaaaaagttattgcggtctcaccgaaaatttaatttgcggtgccctattgcctttttctacgaacgaaaattgttaaaattcgcaaaacagaaagtctactctattattattttaaattcgtcctttagttcctcttgagcctcttgtaaaacttctaatacatcatcagcgtatgaacctaaaagtgtattgctgaactcaaaatttttcaagactaaagtgagcggcaaatccacccaccctgtcaggcaatccataaagcgtctaaatttctcccatagtagtctgggaagtctagtttatcttttaaaacatcatgtaaaacttctatattttcaaagtctcttccatctatcattatttttctcattagaaactatgccctccattattttatcttaacaaacgtttactatgtaacagctgtttgtccaaatgaggctgaaaacaaataaaaaaacaccgataggatgaaactattggtgtttgcaagacattttcatgcccggtaggcataaataatgctaaactttgtttttgaaaagctatcatatcaaatttttatgttatagcttttactatcgtttaatctaattaaggagtaaaacgagatatgtttgaaaatcacatatccccaaaaaattaaaaactaagcggcagttcttcgagtgctctcatcagaaaattccctttccatttcatttgttccttttcgccttttaactgtatatttggacagcggcgtaataaggtggaaatcgcaatctttgcttctaagcgggctagctgtgcaccaaggcaaaaatgattgccatggccaaaagcaatatggcggttgttctttctttcaatatcaaatatgtcggcatttggaaatatcttctcatcacggtttgctgatgctaaagaaatgatgatcacgtctttccgtttaatttcctgcccatgcagtataaacggttcagccgtccagcgaattgtcgttagctcaacagggctgtgaaaccgcaatgcttcttctatggctgaattcatcaagtctggctgctggcggagcttttctaattgatcaccgtggcacatcagagcatatgtcatattggtgattaagtttacggttgtttcatgacctgcaacgataagcagcataatcatcgagtacaattcttctgtacttaattgtgtgccttcactttccgcttgaattaatgcactgattaaatctcctgaaggttcgctcctttttttgcgaactaaggattccagatattcaacaaattctcctaacaaatgatcattctcctggagtctttcaggggcatctgaaaaatcaataattgcttgcgaccacactctgaatttttgacgatcttctaggggaatgccaagcatttcacttatcacgataatcggcaaaggaaacgcataatcgtctactaggttcatgagtttgttgggttgtactttatccaataaagaatctgctatatgttggattttgtcttccaactgcaaaatcatccgatgagtaaatgctttctgaacaagagctcgcaaacgattgtgatccgggggatctgaattaagcatatgctttgttaaaggctcttcattcttcaacagaacaggacggttctcttcttttgcggttattacattttcatagtttttctttaatttttcattctttaataaatgtattgcatcatcatatctcgatatgagccagcctttcccagagttcctaaagataatgggtagagaggctgtgattttcgcaattctttataaaattcatacgcttcatctttaaatgctctcgaagacaattgactttccgtcaaaatggttacactctttttttcttttgaagacattcattcgacctccatctttatgaaaggttatgataatctttaaatataaaatcagtacgttttgtaaaatgatctattgaggtcagtattcgtgataagggccaagatgccgcccccgcattttgaaataaaagggatgagacagtcattaatcattttgctgcccaaactctttctctgataagatggcgaaactcctaatacttctaaataccatgccggctcttttaaggatttgtaagatgttttagcctcattagccacctttaacatgttcaatactgaaaatccccctattttgattaattttattccacctgctgctatataatcgatcaagctaatgtcaggtttatcacgatgttttaatagagcggcaacaacaatttcaccattctgaataccaacaaaacagaaatgctttttaaaatatgcttttgttagtactttatgcatttcaaaaataaatgaacgatcttttttttcgcgtttgacgagtaaatccataaaaggatattgattgaaagattcatggaatagctttgccactttgcttacttcatctgctcttgcttgtcgataaagaaacattgatgcacctccttttccactaaaccattttttgactcatgaacacatgttcattataatggtaagaaaatttgagtatcaatctgcaatttagctgtacatgttcattaatgaacaatacatgataaattgtatattaacggaggacgctatggggacagacgatcaatcaagacaaaaagtgcaataaaacatgcctttttaaagttgcttcaggaaaaagaaatcaacaaaataactgtttccgaattatctaaagaagccgatataggccgaggcaccttttatcttcactacaaagacgtttttgacttgtatgaacagatcgaagacgaaatatttcaacagctaggaagcatttatgatgcatcttttccaagtgatgatccactgaacatactgacctttatagaaaaaacgacagaatacatataccaaaacgtcgaaattttcacattgttaacaaaaccaaaaatgaatgtcctttcaatcaacaaactaaaagagtttttcaaaacaaaaatgattgaggaattgagcatgatacaatcagcaaaatcaattaccgaaattgagaaatttgaaacaacatttatcgtttcaggtgtggtaggaattatagaagaatggattaacaatgggatgataaaaacacctacttgtatctctaataacattcatcaattgttattaaaatttgaagattagcatgtaaagaaggagactttgtgtaaatccaatagattgcgcagagaggtcctgtgttatttcacatgcatatacccttgtgaatttggtcccgctgggaaagaagtaatgaaaaagcgaatcgcgaaaacaaaccagttctcgaatctattagatatagttagctcgggtagctacacgcacatggcattggtggcatgtttggatacctttaagagaatcaacatataaataaaaacataccaatatcatttggtatgttttctttttgaaatagatcctctgcaaataatctttctcaaaccttataacaaatttttaacaagagaataattttggttcaaaattcaaaatcaaatcttgtttctcattttatgcgtatcaaatgtagaacaagcaaatcaattagaagcgttaaaaggccatctataaaaacagatcatctaactaactccatggaactcttctaacatgtttattacgtcgtcccaccttcggaaagctgtatgggcaaatatgtttcaagtggtaaatcatcaaattcgccttcaatttgtttttctaaaatctcaatggccgttttggaaattaattcgatcggctgttgaatagtagtcaattctggcagaatagcctgaatggtttctgtaccgtcataaccaatcacttttaattgacctggaatgtcttttccgcgttttttggcttccgtaatgactcctgcagctatgatatcatcactggcaaaaatcccgtcaactgcaggctgttcatcaaatagttttgaaataatgttcctgtagttatcatgaaatgacacttcatatgtaataggctgtcttccgtgttcacgcatcacatcttcatatgcttttctcctgagatttgcaggcgtttcaagttcaatcggcccattgatgtgaatgatgtgctgacagtccttttttatcaatagttctgctgcctttttgcctccgtcaaagttgtctgagccgacgacaggaactgtttccgataagtaatggtcaattgcgacaatcggcagattttgctggtgataattgagtattcccctgttgtaagtgacggcgatgacgccatccacttgatttctgatcagcatttcgagatatttttcttctttatctattcgatttaaactgttgcaaagcagcagtttatagcccatggacgtgcagatgctttcaatataaaaggcgagttcgccgaaaaacggattgctggagtttggaatgataagccctattaaattggtgcgctttcgaaataaagaacgggccaaatcatttggaaagtaattgatttcttccatcgccttgtaaactttatcttttgttttttcgcttatatagccgcgattatttaataccctcgaaacggttgtagatgaaactcccgctaattttgcaacatcgtgaatgctaggcttcattccctttccccctgcttttactgaaatggcttacaattctcgtcacgcacttattttagagaatcagcctgacatgtgcaaggattttccatagttcgtagtatatactcaagttcgttctttaaatttagaattatgcataaatttatgtcaaccggttgacatatgaaaccggttgacatacaattcttcttgaaagcgcttttacatttttgtgcaaaaggagggaaattaatgaatatgaaaaggttgatgttaggaagtttgtcgttgctgctcatgtttgcagtctggggttgtaacaaaagcgaaagcgcaaatagcagcggaaagaaaacggttacaatgtgggtgcacgtatcggatgataatgaggaaggaaaggtttatcaaaagcgggtggatgcttttaataaaaagtacgcttcagaaaatgtcgaggcgaaaattgaattcattccccgaagcggcaacggtggaggttatgaagacaaagtgaatgcggcactaacaacgaacaccctgcctgatgtcatcactttggacggaccaaatactgcggcttatgcgaaatctggcgttattgcacctttggatgagtttattaaagaccaggatgatttattgccaagtattaagcagcaaggcacctaccaagggaaactgtatgccatcggcgtcagtgaatcgtcggtcggcatctactataacaaaaaaatgcttaaggatgccggggttgatttgaaaacgctgccaacagtgaaagatccttggacatggaaagaatttcttgagctttgcgaaaagctgaaaaataaatacgataaaccagccatcgatatgcaattacagtcaaaagacgaaatattgtcttatgcgctcttaccgtttgtttggtcagctggtggggatattctttcagaaaacgggaagaaagcggatggcgtctttaacaaaaaaccaacagttgaagcgatgacgtttatacaaacgatgcttaaagagggctacacaacacgcacccctgtcaaacaagcgtttgaaacggagaaatacccgatgaagatgagcggcgtgtggacaataaccgatctgaaaacaaactttcccaacgtcgattatggagtaatgccgtatcctgtatcgccaaaaaccaaaaagctcgtctctccttcgggaagctggcagttcgcaatgacacaagcgtctgaaaataaagaatgggcagcaaaattagtagattggatgactaataaggaatccaatatcgaattgagccgatcaatcgccgccctgcctgtacgttattcttcagagaaagtgctgacaaaagaattttctgatgagatgaatgtctttatgcagcaactgaaagaaacaggccatgcacgtccggtgacaccggcatatccgcaggtaactcgagcatttcaacaaacaatcgatgatattagcttttatgatcaaaatcaggatattcaaaaagtgctggatacacgtgtaaaagaaatgcaatctgccatcgataaggcaaactagcaggtggacgccatgaataaaacaatattgaaagagactagaccggccttgccaatagaaagaaagacagtgaataaaatacgctggcgggaaaacgcagtcgcatatatgttcttaggaccggcgttgcttattttattaatgtttcttgtgattccttctatcatggctgtgtactacgcatttacagattactatttgttgacgcctgatttgcgtaagtttattggctttgataatttcatcaaactttttcaggacccaatattcttaaaaagtttgggcaacaccataaaatttgttgtcttattgataccgttacagatcggggcagcacttgggcttgccctcctattgaataaaaagcgcaaagccaacgcatttttcaaagtcgcatactttagtcctgtcgtcatgtcactggttgtcatctccgttttgtggatgtacttgctgaatccgaatgaaggtatgataaataatatattggcgcacttcggtctatcaccacagcctttcttgacgagccctaagcaagcaatctttacgatcgttgtcgtttccgcttggcagggagcaggttttcagatgctcatttttttagctggtttgcaaaacattcccgaggatgtctacgaggcggcacaattagatggtatgaataaatggcagcgttttatttacattacattaccattgttaaaaccgacatctgtttttatctttatcacaacgctgatcagcgcgtttaaactccttgttcagcccatggtcatgacccagggcggaccagtcaattcaacgatgaccgttgtctattatatttatcaaactggatttaccgatcggatggtcggatatgcaagctcgatcgcgctcttgtttggaacgattattggattggtgacactcgcacaacgcaagctggttaaggaggatgaagaccattgagacgtaagttcgggcctttgacaattctggagtatacgtgtcttgctttgctggccgttctatttatctttccgctaatttggatgattgcatcttccatgaaaccggaagcggaaatttacaataatatgaacagctttaaagcgtttctgccctctcttcatctggcagaatggttttcgtcctatagggaagtgctgactcggtttgatttgcttatgtatattggtaacagtcttttttatggtttgtgcgtagcagttggatctgttgtgattaacggaatggcagggtttgcattcgccaagctgcaattttcagggaaaaagatgctctttggcattttgttggcgcttttaattgtgccgtttgaaacgattttaatctcacagtttacaattattcataaaatcggtctggtcgatacacgccttgccgttattttgccggcattagcgggggcattcaatatttatctgttccgaaactttttcatggcaattccggaggaaatgattgaatcggccaagcttgacggggcaaatacatggcaaatcttctggcggattatgataccgatgtctaaaccagctgtagcaactgtcggaaccttagcctttatcggcagctggaatgattatatttggccgctaatggttttgacggataagtcgaaatttccgattcaagttgcgattacagctatcaacagcacagagcctgtctacacaaatcaagttatggctgtcttgacgatttccaccatcccattgattttaatttatattgtggctcagcgctacattttggaaggtcttagcggttcaggaacaggtattaaatagatatcaatgttgggttaaaggagctgtagaaatgaaaggctcaaaaagtctgtattggaaactgagcgcttatcttttctttttctttttcacatggtcttccagctactctttgtttgcgatttggttgggacaggaagtcaaattgaatggatcggcgactgggattatcttttctgtaaacgctatctttactttatgcatgcagcctttatatggctttatctctgataaacttgggctgaagaaaaacatattatttatgattagtatacttattgtttttaccgggccgttttatatctttatctacgggccgcttttacaatatgatgtcttcctcggcgccattgtcggtggtatttatttaggaactgcttttcttgcgggagttggcgctattgaaacctatattgaaaaggtcagccgaaaatatcagttcgaatacggcaagacaaggatgtggggttcacttggctgggcggcagcaactttttttgcaggacagctgttcaatatcaatccgaatatcaatttctggattgcctccctttcagcagtcatattggtggccattattatgtccataaaaattgagatgacagattatgataaggaaagagcggattcgatccgattaaaagacgtaggaggactttttctattaaaagacttttggtttttaatgttgtacgtaatcggagtgacatgtgtgtacggcgtctatgatcagcaattcccgatttactacgcttctttatttcccacttcagctatggggaatcaaatatttggatatttaaactcatttcaagtatttattgaagcgggcatgttgtttttagccccctttattgttaatagactcggtcctaaaaaaagcttgattctcgcgggatttttgatgtctttccgtattattgggtctggaattgtcatcggaccgtttggaatttcatcgatgaaacttattcatgctttagaattgccaatcatgctgattgcgattttcaaatatttagccgcgaattttgatacacgtctttcatcagttctttaccttgtcggctttcaatttgcatctcaagttggtacatcgattttctccccgattgcgggaggtttatacgatagtataggtttccgtcacacttatcttttcatgggaaccctggctttgtgcttcacaattatttcaattttcactttattagattcgaagaaaggtgttgcgtatactcagccttttcgaaaaaacagatatagagaggatgtcacgaatggatagaatccaacaggcagaggaagctttgaagaaagcggaggaaaagatgaacactcgttatcgattagggtaccatattatgcctcgggcaaactggataaatgacccaaacgggcttattcactataaaagagaataccatgtcttttatcagcatcatccgtatgatgagaattgggcacaaatgcattggggccatgtaaaaagcaaagatctcattcattgggaacatctcccggtcgctttagcccctggtgactcttttgataaaagcggctgtttctcaggaagcgcggtagattataatggaaaacttgctttaatttatacagggcataatgtgatagatcaagagaaggacattttctatcaaaatcaaaatatcgctgtcagtcaagatgggatcgtgtttgaaaagcttcaggaaaaccctgtcattgcgaaaccgccggaagacagctcccgccatttccgcgatcctaaagtatggaagcatcgggacagctggtatatggtagtcggtaattcaacgaaagaaaacgtcgggcgagttattttataccgctcgcctaatttgcgagattgggaatacaaaggtgttcttgcccaaagtgatggaaatctcggctatatgtgggaatgtcctgacttcttcaaattgggcgacaaacatgtcttgctgatttctcctcaaggcattgaagcagacggtgatttatataagaatttacatcaaaccggttatttaattggagaatatgatgatgaaacaaacgaatttgtgtacggtgcttttacagagctggattacggccatgacttttatgctgtacaaacgttattagacgataaaggacgcagaattgccataggctggatggatatgtgggagtctgagatgccgacaaaagccgatggatggtgcggtgctttgacattgccgagagaattaacattgcggaaggatcataaaattttaatgaatcctgtggaagaaactaagttgttgcgaaaatcaaaacatctggattgtgctaatcagttgatttcagggggttacctggcaaaaacagacgaagagcttcttgaaattcaagtcgtatatgacttaagagattgcagtgccgaatcagtaggtttgaagattcgcggccttgaagaagaagaaacagctatcaaatacagcataactgatcaaaagctctcactcgattgttctaaaatggggaaatcgcgagacagtgtgagaaatgcgccgctagaagcaaatggaaagctgacactgcgtatatttattgacagatcctcgatagaagtattcgcaaaccatggagaaataacgatgactagccgcatttatccgaaaaaaaatcgattgggaattgagcttttttctgagaaaggcgttgtaagggttgaggaattcacttattggactttaaaagacatctggaaggaagatgaatcacttgaaaaaaatattttgcatcggtgaaacactggttgatttcattccagtccaaaaagaaaaggctttacaagatgtcactacctttgagcgcgttgccggcggtgcgccaatgaatgcggcaatcgcagctgcaaaatacggcgcgcatgccgtcatgctgacgaagattgctaacgatcatttcggggattatatagttggcgtacttaaagaaaatggcgtagatacctcttatattattcaaagcgatgaaggtgaaaccggattggcatttgtatctgtagacaagtctggggaaaggagtttccatttttatcgaaaaaatgccgccgatttgctgctttcaccggatgaattgatgtcagaaaggtttaatcaaggagatatgcttcacttttgttcaatcgatttagttgacagtccaatgaaacaagcccatatcaaagttattgaggactttcaaagaataggtggaatcataagctttgaccccaatatcaggcttcctttatggcctgatgaggcaagctgccgtgaaacgattcagaggtttctgcctcttgcggatatcgtaaaagtgtctaatgaggagctgcagtttatcacaaacattgataacgaacaagaagcggtcacatcgcttttcaccggacttgttaacgtcgttgttctgacaaaaggtaacaacggtgcggcgatttatttaaaaaatggcgagtcgcacaaacataaagggtttaaagtcgctgtttcggatacaaccggtgcgggtgatgcctttatcggcggttttttatctgaattgatgtcaatcggcatatcaaaggagacgctatgcgaacaaataagtaaacatcaccgacgcttgctcacgtttgcaaatgcaagcggggctctcactgcttctgtaaaaggagcaattcacgctgcaccgggcagacagcatatactgaactttatttctgctaggaaggaaatccaagagaaataagaacttagaaataatccattcatattactatctcttgcaagtaccaacttttaaacataacaagggtgatattaatgataaaagaaaaagagaaaatgttagccggagatttatatgatccgtcggactccgagttagcaaaagacagacaaacagcaagacaacttgttagaatttacaatcaaactacagaaactgaaatagttaaacgggttaatttattgaaaaagttacttggttcatctggagaaaacgtatatatggaacccaatattaggttcgactatgggtataacacttatgtaggtgataactttttcgcaaattttgattgtacaattttagatgtatgtgaagtgcgatttggtgacaattgtatgcttggccctagtgtacaaatctatacggcaacacaccctcttcatccaaccgaacgcaattcagggttagaatatggaaaacccattacttttggaaataatgtatggatcggaggaagctcagtcattaatccaggagttacgataggtaacaatgtggttattgctgctggtgctgttgttactaaaaatgtgccagataatgttatagttgggggcaatccagctaaattaattaaacatctcgaaatataatacactagcgttttgatccacaaaggagtttgattcttaaatcagtaaggctttattttgtttcatcagctgaaaccatcataaaaagactgtaaaaatggacctaaaatgaggtaactgaatgtacctctccccttcttctacagaaggggtttaattgtctcagccgtcccatataacttaatgaatcacgttttcaatgacacaacaaaggcgaagggcaggcatgggtgcctttgttatgtggaagtgcggtttggaaagaaattgagatttcagccgaggtgctgcctgtggttaatagttctattgagcaagtaaagcatgaaatcgaattaaagcgcccttcctattggaaagacgcctgccgttttactgtgccaaaatgtttttcatcagtgagtttttataaaatcatttattaattgatcagttgtcaatattgtggcaaattcatcatgcaatgtagctagagatatattatgaatagtcgccgcatcataatatgtatcattttggtctctcattccgaaggctgctgttgcatctgaaatcaggtatgtatcaaaccctaaattaccactcattcttgtggtggttgatacacagtgaggcgtggttaaaccagttatgactacagtggttatttcatttaattttaagaattcttctaaattcgtaccaataaagctgctatttactgtcttggttataatgacttcttcatccataggcttaactatttcctttatcgcaaacccttcattctttggatggaataaagaatgaggtttatcagaagtgtgttgtatgtatatgactgtccatcctttttctctccataattttagtattttactaatgttttcttccgcctttacgttattccgttccccccattttttatcatcgaaggctttttgtacatccacaatgattaaagctttcttttcttccacaagataccctcctacgtagaatttctatttattactacattctaaatacaaattttacttttgtacaattgtttaatgatgaatttcaaatgagcgccttctttattggaaaatgcgttctaaactgcaactgtgcccaagccgttaaccttcaataatctgagaatctgaatctacagagaatgataaaaagcactcaaataacgagtgccgaaatgaaaaactattgatttagaagccatttgatacgctcagctgaaaagatgtagtggagtattattagacataaaaagacaataccaactggttttaaatgactaaaataaagcgctgcaacagccattgcaaagatcaataattcaataactaaccttgttaccccgtttacagctattacagtttgtccgcttcgactaggatcatgaggtactgcaaatacagaccagacaatcataactgcaataggtaaaaccaaagttaaaacatatttaaaataaccattaaagcttatccaagcaaacacccctaaggagattagtgcagcaatttcaagggtgaatcttaaaagtaaattagtctgattcagttttttcaactcctctataaaaaacacccccgcaggagatgctctttctctgctttatttcagcgtataaaaacttttctgttcttcctctttagattcttttgtagttttcggcgagattacctctacttttgaagagatgataccgactgctgctgttaccaatgctccgattaatagaacgatgataagtataatgaaatatgacaacttttcccctcctatccagttaattatccaaataatcaggaagttgtctacaatttgcagaatttgtcgaacgaagtaaagaatataccttggaggctttactcattgtatgaattacagtaataaattgccttcccttttgagaagacgttcccctcttatatccatttgttgcaaattagctagactcttccaataggcttccttttggcgcagctgcttctagtccaaattgagcaacacctgaatgtttcattggaatttctgaaccatagatcgaatttgttgcaaatgcatacgtaggagtagtcgaatggcggttgaagaatgaaatgccttccccacctcgagtgatggcagaaaaaagtgggggttttgttagagaggaatctatagatatgtgtattgaagatttgacagcattaaaaattatacctacatcgttgggaataggccaacaataaatcggaagaacgttgtcatttgaagtgtttggaataaaaatgattcgaatatgttcttatcattggtaaacgaacaaaaaaagaagatgttttgaaaaaagatagatcaaaacatcttcttatatgttgtcatagcgtaacttttttataaaaaggttgattacattttcggggcttccaaaccaaattttacccattcttcttttgctggaccataaatacctggaacagttaaacctgcttgtctcataagaacagtcatttgtcccgatggtgattttgatgttgaatcaaaaacatcaaaagtgaaccgttaggcaattgttgtccgataaagttgatacgttcttgaagtgtatggtcagtccattgggtttttaatgcctgtacaaatgcattactggcttgatgatagctgtcagctataaactgagccgaagttggaacaggataatcttcagctggtgcatggaacgttaagtctgtgtttgaggtaatgatgcgaatggcagcaacagtatgccaagcaatacggcctagagtccaattttgtgaagttatttcttgtttaagtgattcatcagttagactatttaatagtttctgtgtagcatctgcttcgaactcccaagatttcaaaaaatggtctaaggtttgaaacacaaaaatcctcctttttattcttttgttttttcaatgtgcctataggttaattataatgcctcgtttcgttaaaaagaacaaaaattttggacaagaataatcatagtaaaatgcgtagacattcttaaacataacgatttacgcatctttttacaaacatggtgactccttggtctccattgtcagcgagaatcaaatatcatatgaagacaatcctatattcttatcactttactgagcaataaataccttccgtatacttagtgatgccttcatcgtaatcaggatacttatatgcaagactttctgatacagcttttgaatactttctaaataatgcatagcaagtaaataaagacttccacatttcctgataaccattcacagaatatgtagacatgagttcctcccattctttatttgaaaggtaccgtttcataaatttatagttcttccccatactaaatgaataccctttctgagatgcgatatgccaggccatcattctcaataaattaggacgtacaatttcatttaaatggtcaatggcaaaaaggatttcatttcttgctaatccttttactacgtaagtcgaaaccatccagaactcattacagcaatcatcaaattcccttgcagtcggctttttcatccagtattggcgatcatttggggtcactttatagttgatgaacgaatccttatcgagcaataccttaaccaaaccatcgttattagcaaaataatcttctgcttcacgaattggaataagggttagatctaatttgttgccatcctcaaaaagaataatgtatgaaaaccaattacctaattcgggaggaaaaagctccatatcttctggtttttgcatcataatgcgcttcccaaagatttcgagccactgatcattttctttaaaagattctacatcagttacaaaatacgagatgtcataatcttggaagttgtcaggagggatatttctgtttgtacgtgacccttccaaagtgaccaatcggattctctcatcgttcaaagcaaagtccaaaaaaatgtccatcatttcctgctcacttcgcatctcatgttcctccgtttcagccttaatatctaactgtaaaaccgaatattgatctgtacgtcttatagatttttttactcttgaatgtgatgtattcttctaagctttattttacatgatgttctcctatatatcattcaatattaagatgcaagacatctcaaaatcagatatcaactatgacggactacatgaatattcagttttttgtagagccgccatgggacgacactatctttgacacactttaatcccccctgctttatcgacatgttaactggtatgagagattgacaaaaagaaggaaaacgatatatttaagcgaatacgagtttttgagtaaattttaaaatgacacttttttcaaaaatcatgtcttaacggggggattcggtatgaatgaatttatgaagaagttttccttaacaaaaccgattattcaagctccaatggctggcggtattacaaagccccgacttgcatctgcagtttcgaatcaaggtgctcttggcagcttagcatcggggtatcttacgccagacctgctagaacaacaaataaaagaaatgtttgagctgacagacgctccttttcaaattaatgtgtttgttccgctaggtctagagatgccaccaaaagatcagattaaaaagtggaaagaaaacataccgttagctaatcaagtaaatcaattcacatctgtacaagaagaatgggatgacttctatcaaaaaattgatctaattttaaaatacaaggttaaggcttgctcattcacttttgatctgccgcctgaagacgcagtaaaggagctaaaaaccgctggatgctgtttaataggaaccgcttcaacagtagaagaagcattgttaatggaagaacggggaatggatatagtagtccttcaaggaagtgaagccggtggacatcgcggagcattcttaccttccaaaggtgaatctgccgtaggtttaatggctctgattccacaagcagcagatgcactgagcgtacctgtcatagctgctgggggatgatagaccacagaggagtaaaagcagctttaacccttggagcccaaggagttcaaatcggttctgcctttttaatttgtcacgagagtaacgcacatccagtacataaacagaaaatactagaagcaaacgaagcagatacaaagcttacgacattattttcaggtaaagaggccagaggaatcgtaaataaatggatggaagaaaaagaacagtttgagacacaaacccttccgtacccttatcaaaatacactaacgaaggcaatgagacagcaggcttcacttcaaaataaccatgatcagatgtctttatgggcaggtcaagggatacggtcattgactgaggaaatttcggttaagcagcttttaaatcagctttgccaagaggatataaaaatataggcgcacctcattgatagagcaaaaagcaaactttgacaggcagtttgcttttttttcgtaatttcatcccctgactttggaaatttaaatactcctacattttcaaagctaattgagtcgggttatcaatcatcccattgatacgatgcggtcttgatgatttcaccacaaccacaatacatcaccaacatttcgatcttatctccccttctccagttttgctccctattcgaaaaattgatacctcccatattaaattcgaatagtaaaatggttatttttcgtttgattcagatgatataaagtcatatgataaaaaaagaatgagacagaaagcgtgagaagtgatgaaaataggattttttgattctggaattggtggcatgactgtattgtatgaggccataaaagttcttccttatgaagattacattttttatgcagatacgttaaacgttccatacggtgaaaaatcaaagggtaaagttaaagaatatattttcaatgcagctaaatttctggccagtcaaaatatcaaagctcttgttattgcgtgtaatacagctactagcattgcgatagaggatcttcggagaaacttcgactttccgataatcggaatcgaacccgctgtaaagcctgctataaataaatgtacagaggaaagaaaaagagttctggtagttgctactaatttgacgcttaaagaagagaaatttcataatctagttaaagaaattgatcaccatgacctagttgattgcttagctcttccaggactagttgaatttgctgagaactttgattttagtgaagacaaaatcattaaatatctaaagaacgaactatcttcttttgatttgaaacaatacggaacgattgtgttaggatgcactcattttccgtttttcaaaaacagttttgaaaaactgtttgggataaaagttgatatgatttcaggcagtgtcggtactgcaaaacagttgaaaaaagttcttgcagatcgtaaccagcttggtaaaggatcgggctcaatcacctttttcaattcaggccagaaaattgtggaccaagaaatcatatcaaagtacaaaaaattgtttgaaatattagatgaaaatcaaaggagtcgtgttggacattgaatgtaaggggctctggttataaacaatttttcagtaaatttacaaaagggagaagtatgaattcgggtttgttatccaatgtaaatgaaaaagacagtctcctgaagggaaacatgaactaagaagcgggctgaaaaagcccacttcttttctaacaaacaattgagttatgcacacatatctgattacagtgttttcgctctttccccctcttatttctcccccatctctatagcttttctatttcaataaagcacaagtatcgattgaaaagttatcgtaacatgtacacttcacaggacatttttcgagattgcgaatcgaccgtttgccagatatacaaagtcataatgtgtaaattctgtgtctattttcatgttgattatggaattattttcataatgttttataatacaagatgatagcgttttctaattataatttatagggggaaacaatgatgataaaaaaaggactgcttgcgggtgcgcttacggcaactctgctttttggcacatgtgcagtagatgtgccgggtattattagcccaaaaaccgcagaagctgcatcacagctaactgatggaatcggcgggagggcttacttgaacagcactggtgcaatttttgttacgaaaatccagcttcctagctccattcaggtttcaaatgggacagcctatatctactctggctttagcgggggcacagaatccgatatcgggtttcagtacagtgataaatataacgtatggaaaccatatatgaaagtcggttcaaaaggacaggatcaggttcagtacctcgaaggaggaagccaattcacgaatacgaaaggcttccgtcccggcagcaccgtacaacttaccatctacaaaaatcttaacggcaatacccgcgctacatactggggcacgaacaatgcgggatacaacggccgtctcatttcagaaatcagcaaaacaaatgtcggctccatctccaaatggaaagcgctcgctacagttgctacaacagggtcacgccaatctatcaaatcaaacttttctacatcttttacaaacatcaccatcgacaacaaagcaataacacctgtaattgatacacaagacttcgctaaagtaacagtctcaggcaacagtgtcagtttatccgttgtgaaaaattaaaacatgttaaacatacaatgcattaggctattgagaagctctcgatcgtcttaaagggggcttaacatgccccttttttcatttcaatttaactttcagttagcttcggtacatgccgtctatctccgtcttttatctgggtgaagtaaggagcagctcgccccttctgaacctgttccatttgctcaacgcaaaaggtgtgcatcactgtcttaaaaatgttaaaacaaatggcagatggtgcactttatttttagatgaggcatgcttacgctcgatatgcaagtcaaatgattaagggtctgcaagagagaaggaagttttggatgtagttccataaaaggggagtggcttcatatagctcgattgcaccaggaagtgccgagaacaacacatcactttgaaacggattcattccaaaatgataagtatgatccaataactaataaagatcagttagcagtccagccttaggctaaaaaatatttttacatcaattaaactagcatcactatcgaataagctcgatctgcatatcatgtactatcctcttttaaggaaggtgatgttatgaggtcatttccattaattgtagttctattcatcctattaatcatcgttgggacatctttctttggtggctattaagaacacaccttacctcatatccatcagacgccataagaaatctttatggcgtctgttttttattagatttaaacaaaaccatataaagtggggccatgcaaacacacctatggagattactgccgcgacttgtgtgggaaatgttcttccctttatggactattgtcgatcaaaagagaaagttgaaatacctttttatggtgagatgaatcgaggcttagacatataaaaaccgcaaagctttcttgaagaagctttgcggtttttgggtctcttttttgctttgtataagcctatagatttcaagcgaaatcaactggtctcaatccgttgtgggatcaaatgcgtgttgacgttcctctgctttgctgtttaatattcggtagctcgattttccaatgtgaagcggaatatccagtttttctaaatcaggcattccatttttcaggaaaagctctttatcttgatatctctgtaaaacttctcccacaatccactcttgatcgcccaacgtggaaacactgtgtactttacactcataagcaaaataagcatcagttaaaatcggcacctcggcttttagccctttttcgtattgaatatgaaatgcttcaaacttatttatatctctaccactatgggtgcctaatgcttgaattaatcccgaacatctccccggaagaaaattcacaccgaaaacaccacttttctcaatcattttgtaagtatatgtctctttgtttactgatatcccatacattccaggagaagatccaatgtacgtatgccacccagaagccattgcgtttttttcaccttcatattgaacagtaactacagctaccattccagggtaggcgtaccaaattggttcatctatcggtgctctcatcttcatcgctccttttgtttaagatttaatttttattaaaatttgagatgcatcaaaacaacaatgataaaagctaaaccagcaaattagaagtacatgagtatagtgggcagggactgaggtgtcagggtatcaatcaaccgataataaagcagtatctccatcgtatttctcgtttaagtatgcaaaggagcaagctctatactgcacgccccgccaaaaacgataacacgatcagggctgtgcttttgaattaaactttaggcagaccgagcttgctttaatcaaaaactccttccaataatcccctgctctttttcaagatccgcatctaaatcgacaagtacttcttcaaatgggccattcgttttgggagcaagccagtttaataagtgtgctccgagtacgtaagggttgttatcgccttgccattgcggcatgaataaccgaagcgcataccttctttatttgtcatattatacatccttcctttcatgaatgaatatgatgaacaaatcataaaccctatagcagctatagggtcaagggttaattattttttagcactcttaattctgtaaggaagttttcttctcttaatgagttatagtcgattggaagagaaacttgatatacttttccatccgtttggatgccgtgagattcaatatattgataaagcttttgataatactcatcataattttttgcagaccaattaaatgcaatacatacatattcaccagatgggatcgtatctaacctcatgtttttttctcctatgtctatttttttcccactgcaaacagtcgtataaatactattgcaacaaatttcacgagaatccttatagggcttgaaatcataaatgaatccataatagttatctattacatctcctattttttcgacaacgtcagccagctttctgtaatacaaatcggattgattatgaggattaacttgaggcgtctctacttttaatattgtttgtttatctatataccgaaaataaacgaaaccttcatcttttttactgcatatttctaattgttcattaagctgttttcgtctcctatgaagtaattgacgagcacgttcgagcttttccatttcttgcacaataacgctttctttctcctcaagaaagtgttgcatatcttctggggtgcaagtatatgagctgaaacgcttaatttcttctagaggtgtcctaatatattttagatacttgataacatctaaataaaagaactgtttgacatgataataccgataaccattatcctgatctgtataataaggcttgaaaattccgatcctatcataatagcgcaatgtttgaattgagatgttatttagacgggctgtttcgccaattgtaaaatattccttcatccatctcatcctttcgtcttagctctaagaattctttcttacactatacacggttaccttcaaaatcttaactgagcaatcttgcgatcaatctgttatcttctttttcgttttcttaaaaagatccgccaataaatgatctttccagtttcataacaattacatgttaagcaggaaaagtattgaccctatcgtcacaacagggtttatgatttgttacgcaacttaaaatagttggaaaaaggaggggagtatctgtcagaagatgtttaaagtatctactgtagtcgtggcttagtttatgaggcaagtcattcaagactgacaggcttagatgatgtaaatgggtcggtacatataattgaactttttaaaaagcttaatccttaaaaagattaagcttttttcctttacaatgctcaccttatagattccatatcaagacgcaagtctcttgcagcacttcaaggctttacatattacatcccctctccctcgggcctgtcgcttacttggttttagttaacatgtagctttgtgttatcatatcgtatatgtctttatctgggacagttccgtcaagaatgatagaattccaatgctctttattgagatgaaatgctggaacgaccgaagtgtatttctgtctccaaaaatcgagaaaaccgggttcgcacttcacattgatccaaatataatcattttttttaaatatccacgcaaacacctttctgttttctatgtgtcgcattaacgtccaatttttatcacgaaacgggtaatcttcatatacatttttaaagctcaaacaataatcaattgcttcctctctatttttcattgcttgcctctccttctacatataaataactgcctaaagttttttctttagcaattgatttcctctactttatttaacaataatgaatatgtgaataaaagaactatgattaaacaatttgcagatcgggcagtaaattaaaaattcagttgcttttttctgaaagctactttagctattcgggcgcattggagaaacagaggctttcgttggtacccctgcctttcttcggcaatccgctagctgtttaccggcatcatcaaccatcattagtaccgataaacataaacaagctggcagcaataagcaccagcttgaaacatattctttatgaagtggctcccccaactgatcaattgcctcttgttggatgccaacattcattgcagaacgccgtactttcagagaggaaaatgccgcatattttgatatcgcagaaatcaggctacggtgtaattgacggtcttggtccacttaccgatgtatatcgaatgaaggcgggggcgacgacaacgattaacagggtcccggcaaatgccacgatgaaaaaatataatgataaaggaaccaattccggcagcacgagctccagtctcggcagcatcgtgagtttggtcaatacgttacgcggactctattcttcaacgaacccggctaagggatattttcactttgttaatgcaataacgttgttttattaatgttttgtttattttttaggagtcaatgaaaaagaagttaccgctggcggagagagaaaacggacaaaaagctgctggcggagggtcagcagctaaacaggagcatttaagcatttcacctctataaaggacaggcgccattttccacagtgataaatggctgttgcagaacagctttatgataaaagaacaccatacttcatagagtaatcatcatttaatgagccatcatctcatgggcaatatcgtatccatccatttttgacgggtagtaggtaggccagtttttgacttcatcaagtaaagcttcacggtcgtccccccaatagagatggtaatgactagctttagtcgggtaaatactatgatcactaaactgaatatactgaggcagcccttctgcttttttagctagtttgaatatgtatcttacccctctattgcccgcatcataggttagaatttcgtacccgtcatacgtatacttaccagaatattcttttccatttttgaagaacgttacagtatctttctggattacaatacggtcaacatctgtttgatagccttttttataatactctttatattcttcagctgtcttgccgccttcgtgttctgaattatatgaaaacacttcgtcaagagtaccatcttgcaggtatggatatacagattgccaatctccttcccaatcagaaagtaagcgatcctttacttggctgtttttaaaatagccttcatatattttttctgtttcttcatcatgcgcatgactatgatcgtgagaatgttcgtgtgtatgactgtcagatgtttgctcttgcgttttggaagagtcttcttcaactgctgaggatgatgttgttttattagactcacctttagatgaaccggaagtctgacatcctgccaatacgagtaatgaaccaatcgttaatatgcctagccgctttgaaaataaaatgttcattccaacactcctttttattaaatcgaaaacattacgatttatattatacatgcatctcttgcaaacatcaaagggaaaatgctcttcatgcggatggactattttaaaggaataactggctttgttcatcagttattcctttaaaatacgaaagtctacgatatttccatatcgatccgcttcaatatgacagcacccctcaagcagctgttttaattttccccgtccgcgttgtacccttgattttgctcctgagtaagaaatgccgagcttttcactcaactctttctgtgataacccctgaaattcagttaactcgagcgcctctcgatacttttcaggcaaccgtttgatggtcgatcgaatacacacagctgcttccttggtgaaattttcttcctctgcactgttattaaaatgtagatcatcaggcaatatttcgcttgttttttttgtacggtaaaaatcaataatcgtatttctagtgatccgataaatccagctgtcgatcttttgttcatcgatcagatttgggagatgcacttgtattttcataaatacgatttgcaagaggtcatcaacgatagattgatcgttaaccctttgtgaaatatatgtttttaacggctgatgaaattgatcccatagatcctctatattcatttgaaaaaacctcctataattttgcgtctgctttacatttgcttcgtctttttaatcgtaacaaagagcgaaacaattgttgaatcaattgtattgcagctgttgcaaaaaataatgataaaggagaggtttgttgtggagtatacctatttagggagaacaggattgcgggtgagccgtttatgtttaggcacgatgaattttggagttgatacagacgaaaagactgcgttccgtatcatggatgaagcgcttgataacggcatccaattttttgatactgccaatatttacggctggggcaaaaacgcaggattgacagagagcatcattggaaaatggtttgcacaaggaggacagcgccgcgagaaagttgttctggcgacaaaagtatatgaaccgatttctgattcgaatgacgggccaaatgatatgaggggcttgtctctatacaaaatcagacgtcacctggaaggatcactgaagcggcttcagacagatcatatcgaattgtaccaaatgcatcatatcgataggcggacaccgtgggatgagatatgggaagcttttgagactcaggttcgctccggcaaagtagactatattggatccagtaattttgcaggctggcatttagttaaagcgcaagctgaagctgaaaaacggcgattcatgggactcgtcactgaacagcataagtatagtttattagaacgaacagctgagatggaagtgctgccggctgcacgggatcttggtttaggagtagtggcgtggagtccccttgcaggagggcttcttggcgggaaggcattgaaaagcaatgccggaactcgtacagcaaaaagagcagatttaattgaaaaacatcgtttgcaactcgagaaattttcagatttatgcaaagaactaggagaaaaagaagcaaatgtggctttggcatgggtgctggcaaatccagttttaactgctccgatcatcggaccacgaacggttgagcagctgcgtgatacgataaaagccgttgaaatcagtctggatgaggagattctccgcatgttaaatgatatctttcccggacctggaggagagacacctgaggcatacgcctggtgatacattcattactcaatactgacatttttcttaaatatttatgctgaactatcatatataggaaagacaagggcttgtttgtctcttgtcttttccacatcgtgctgaaaatgctggctaaacatcgataagaaacgctgacgttttactcattcaattgcttatttgattacgaaattaccgtactcgtttgaacgaacatgaatcggtccgtttagattatagttgttctccttggcgatagagcgaagcacgtccacacgggcaactgattctctccattcgtcacgggtgtcatgattggccggattcatcagatcgtcatagcgtacctccaagaatttatttaaccacttcttctcgtctattccgtctttaggtgatccgcccgcttttttgttcgtacgtttaatcaaggcataaaaagagtcagggtcatcaccatcgccatgctgaataaccgtatcgtacatcacagctcttgccaatgctgtttttagtccggcattatccgatcgtttcatggcaggctgataatacaaacggtcatttactttgtcttgagcggcgcgaaattccttatcatttgcaagcgacttccaagcagaagcgaatcccttgagattgcttgtatcatcgctttcttccttggccagacggcgcaattcaggcagatactttttcagtttgttattcggaactgcctttgtgtatacttccactacttccaatgcatccccggtagccgttgtaaagcctgcccgtccgcatgtatagcctcgcccgtcatccaatcgctctacatatccatattggatctccgttgtgccgttttcaaagatacttgtcagctgttccgcccggcgcttttgatctttattcagtcccgccgcaaaaaccgtttcgctcatcatcagggtaaaaaacatggtgaaaacaagtaatgagatcgctgcctttttccaaaaatctgctttttgcatactgattttcattttacttcccctttctaaatattgtaaatacagactcagtatacatgaagaaactgccctattgttgaaaatacatcaatttgtcaatattttgaatctaaagtaatatagcttgaatcttactcttttgattgccaatcagccttagcccctctcactgggaaggtccctttcttactgccaactttaattaacaagatgccataaggctttactctattttataatggaagtgatcatcgaaaatcgttagggaggtgatgtaaatggcaagcaagatgagaatgccagattccgcaacgtcccatgcaaagcctattattgggaaggcgatactttgcatggggtagactttctaaaagatcgcccaagtaagcttttctgatatagtggctttgcaccttatttgacataaaaaaataaggagctggcagaaatggcatatgtaaaagcaaccgctattttacctgaaaagctgatatcggaaattcaaaagtatgttcaaggaaaaacaatatatatccctaaacctgaatcctctcatcaaaaatggggtgcgtgttcaggaacaagaaagctgatcgatgacagaaacgcttctattaaaaaagcatttaaaaacggcaaaaccattcatcaattatctgatgaatatcacctctctgatgaaacaataaaaaaaattgtctactctaaataaacaaaacggaagcactgatgaaaaatcatcagtgctttttatatggcgagtttgtttcttagttatttcctgcatatgataccattggccaattgtgtaaagttaagggagatgagaagaaaggaaggtcctacaaatgacgataaacaatggaacgttgcaagtacccggcgcgaacatccactatcaggtgcgtggctcaggtccaatcattcttttggtccacggcggaggcggtgatgccgacaagttccatcatgttgccaatcatctggctaactggtactcggttgttacttacgatcgccgcggccattcccgcagcaatctcgccaatcagattgaggattaccgtgtggaaacacacagtgacgatgctcaccgtcttctagccaaaatcaccaataaaccggcatacgtatttggaagcagctccggggctgttatcgggcttgatctgtgcatacgccatcccgaacaagtacatgtcatgatcccacacgaaccaatcttattgcagcttctgcatggaaatgagctgaaacaagccgagcaattcatggaagaccttaagaaaaatcaccgaagtgaagtcattaaattaatgtcaagattagagacagacgaacaatcaaaggctgtcctgacaaagcggcttctcggcaattcaacgtatttcactgagtatgaaattcaaggaattctcagctatacattagattttgaagcattaaaaactgtgtttacatcttcaccgataaaggtactcccagctggcggaagtgcttctcgggagctttttccttatcgttgcgcgaacgccctagcggaacaattggaaacagaattggttgaattccccggaaatcatacggggtacacaatgcatcataaagaattttctgagaggttacacgacatgttagaaaaagaaaagaaacatacgtgttcaaaataggacaggtaaaactaactatagaattagagaagatttcacgaagcgtaaaaagaacttttcactaacgagaacgcaatgtgagatgtctaaccaaagtgatattagggatttcatcgaaaaataggtttgtacattacgttctcctattgattatttcctattttaattccgtattttataccattagatacaactctaaagcggctcgttattttgtcctcaacaacaaccagtgtctaacatcatgaatctcttttgaaaattaccacaaatgcaggtatggaagacttcatcgcagcaaaaaccataccaactaatgttgttggtatggttcgtcctagataggcccttaagaagagattctattgtacggagtatttaactaattgcatttgtaaccgacagggccgtctgagcctgtgtacacatatgtgtcagacacatatccaatattcacgatccccgggaatctttccactggatttggtcccagatattactcgttccatacttccctgtaacagtcgttccataagcgtaacaataataaggaacacgggagccgctcggaatggaaagcataataggataatttgtaccaggaccgctgcgcatattgacaggcgcaccgctgcttgttgagacagtaaagtactgaacggcaagtgcctgactggaaaaaatgaataaagatgcaatcatcacggttaacatactcagcattttcagtttagtcaatgtcatccctctttcttcaattccttcattttaagaaacgatagaacatatgctaccagctgcatttaggaacaactggaccgtctgagcctgtatacatatatgtatcagagacaaatccaggaacgatttccccgctggcaagcgtccgctctgtgtaattccaaatattactcgttccatactttccagttacagttgtaccggttttgtagcaatagatcgggatgcgggttccgctcggaatggtcgttacaattccccaacttgtacctgggccgctgcgcatattgacaggcgcaccgctgcttgttgaaaccgtataatactgagccgcaagtgcatggctagaaaaaatgaacaaagatgcaatcatcaccgttagcatacttagcctctttagcttattcaccttataccctccccttataaatgccgtacgtttgactttcttacatccagttaaggatttactttcagataccatgccccctcccctcccatatatttatcaatgtaccataaactagatctttcaaaagtggaattattcctatgttttcgacaattaaggatacaaaataaatggtagtcaggcttatattgatggtatgttacatttggctcttaatcatttgtccagtcatcaaaaacggacaccaaacaaatcagcgtaaatgctgcaagttcagtgtccgcaacctattatgactttgctttcttttaccagggcgtataaaaatgattaggtacgttctcaaacgttattctatgattttgcgagtcgaaaaatcataacattttatatatttcaatcaggttatgatctggatctctgaagtgagcaactcgggcactccattccttgcgatcatgcggtttattcacacatttaactccttttttgtgtaaatcgtcatacattttatcaacatcttctaccttaaactgaagcaaaaattttgattgagcttctccttccaacgatttttttccctctccaacgatttcagccatcgtttctcgagataaaagctctattttcgtttccccattatcaaagagtgcatattccatttcattctctaaccaacttattggaagtcctaatgaatctttgtaaaactcgacgcttttcttaaaatcattcaccaaaagtctaatttgcaacagcttcatatcgagtgcctcctataaaaccatactttttactggtcatccaatttaatgatacaaaaggaaacctgacagcactatgtcaagtttccctaaataaatttccataccttcacctttataagtgcagtttattccatgtcttaagaaatgtacgctaacgaggaaaaacagcgattcttaaaacaaaaaatgataacgagtgtattttctgtatgcttcaacttcatttcgggaaatgtaacgttgataaaaggaggttacatcaatatggatcatcaaacattggcagctcacgaggctgttgacttacatgaaatcgtgaactttaaaacactttgtatagcgaaatcaaagttaatgcaaggacttgtgtttgaccaagaactgaaggacttgatgcaaaaagatgtgcagcaatccattcaagaccttactgaattacaggcggtttatgagcgtgcctcatttcagtcccctgtccctcaaagccgcccaacgccaatcatcaattgaaaggaaggtaagcctctttgaataatgatcatttagaccccattaattcgctgaatgtgcctgaactagcagacactacattcgcgatggattttcttatacgagctaaggaaggcgtaaggaatactgctgtagctttgacagaaaccgcttcaccagatgtaagagccttgctgcggaaacagctgatgcaaggaattgcaatgcaccaagagattacggaactgatgatcagcaaaaaatggttccacccatatgagctgagcgaacagtataagctggatcagctctctgcaaaaaacacgatcatggtcggcaatatgaacctctttcctgatgaaacaaatcgtaaagggatgtttgaccggacacctgatgaacactaacactggaggttgtacagcatgaaggcagtaacgtatcaaggcattaaaaatgttgttgtcaaagatgtccccgatccaaagattgaaaaatccgatgacatgattatcaaagtcaccagtacagccatttgcggatcagatttacacttaatccatggattgattcctaatctccatgaagactatgtcatcggccatgaaccgatgggaattgttgaagaagttgggccaggggttacaaaggtcaaaaaaggtgaccgcgtcattatcccttttacgatcgcctgcggtgaatgttttttttgtaaaaaccagctggaaagccaatgtgatcagtctaatgacaatggggaaatgggtgcttatttcggctattcagggcaaactggcggttatccaggcgggcaagctgaatatttaagagtgccgtttgcgaattttacccattttaaaatccctgaatcttgtgaggaaccagatgagaaattaagcgtgattgccgatgccatgaccaccggcttttggagtgtggacaatgccggcgtaaaagacggcgatacagttatcgttctcggctgcggaccagtcggcctgtttgctcaaaagttttgttggctaaaaggcgcaaaacgcgtcatagcagttgactatgtaaactatcgcttacagcatgcgaaacgtacaaacaaagtagaaatcgttaattttgaagaccatgagaatacagggaattatttaaaggaaatcacgaaaggcggagcggatgtagtcattgacgctgttgggatggatggtaaaatgagcgatctcgagttccttgccagcggcttaaagcttcatggcggaacaatgagtgcattggtcattgcctctcaagctgttcgcaaaggaggaaccatacaaattacaggtgtgtacggaggcagatataacggttttccgctaggagatatcatgcagcgaaacatcaatatacgctctggacaggctcctgtgatccactatatgccgtacatgtttgaactagtatcaacgggcaaaattgacccgggagatgttgtcagccatgtcctgccgcttagtgaagccaagcatggctatgacatttttgattcaaaaatggatgattgtatcaaagttgtgttaaagccttaaaaaacggaggttacagaaatggaatacgccttacacgaagtgcttgaggttcaggaaatgactgctttcaagacactttgtttgacgaaatctaaaacaatgaaagcactggtatctgatccgaagctgaaagaaatcatgcagcaagatgttgatatcaccacacgccagctgcaggaatttgcctctattttatctaatgcaaagcacgaatgaggagatgaataaatcatgaatcctatcattgaatatctgaccggcatgaatgttctaacagaccaaatcattgctatggacttattaattgcagcaaaaaacggagtcagaaattatgcgatggcagccactgaagccggaacgcctgaagtgaaagaggtccttatccgccatttggaagaagcccttgatatgcacgaacaactctcaagctatatgatggaaaaaggctggtaccatccttggaacacagacgaacaagtcaagctacatttaaaaaatattgatacagccattcaattgccaaccctttaacatacaatgagtgatttgctgaggaacagtattgattggccactactgttcctcagcttcaaaatgagcactgtttgttcgggtcctatgaccgtaaatagattaaccgcttttctccatctgatctccgataatgtttgcaaattctccaatcaaataagaattcgtaaccacctctttttatgcgatttcttgatggagaaaacaggccagaaacaaaatccttcgtttttgacctgccctcttcacacgcaaagaatgctaccttctttgctccactgatccgtgaagactttccgttttaggcctgcttttgagctttgcctcattttcacgcaatttcccatcataatctttaatttttgtgtctaatctcttaattgtttcatcaatttctttccgcttctctatcagccgctgtcgttcgtcagccaggatattttttcgagcttctactgtacggtcaccttcggtaaataatgttgtatattcaattagcgcttctatcgatagtcccgcatttcgcatgcatttaatgaattcaatccatttgatatcttcttcatcatagtcgcgaatgccgctgtcttttcgttttacaggcgggattaatcctacacgttcgtaatatctgagtgttgcggctgtcaggccaaactgctttgccacctgagcaatattcatgatcttcacctctctatcctgcatgttgtgaaggtaacacttaaagttaactttaagtcaagctcaagacaagtggttagctgctgaatctgggtttatatattcgggacttgctttaaagcacactttaagctctatacttctccatgcaataaaaacagtgtagatggggggattgctgaatggcaaataaactaactgccggaagagaacaattaggagaatttgcgccaaagtttgctgaacttcatgatgatgtcctattcggtgacatttgggcaagagaggaagaactttcccccgagatcgcagcatgattacagtttctgcgttaattgctgactgtagctcaccttataaatcaggttcattttaaatgttatttttaaaaaacccttgccttaaagcagactttaaggtttatcgttatgttgaagacaccataaaacataaataagtgcatgtttttttacaacacttatgatgaagaaaggaaaggttcatatgtgtaatcaacatcaaacccgtgtattaagcgtggcacatgcaaaagccaaatttgaacaaacgacgattgagcgaagagaattacggcctcacgatgtcttaatcgatattaaattcagcggtatttgccattcagacattcatagtgcttttgatgaatggggcggtggcatcttcccaatggtgccaggacatgaaatagccggtgtcgtaacagccgttggaacagaagtcaccaagtttgctgtcggagaccgcgttggtgtcggctgttttgttgactcttgcggagaatgcgaatactgtctcaacggagaggaacaattctgcacgaagggtgttgttcaaacgtataactcagtagactacgacggaaaccccacttatggcgggtacagccaagaaatcgttgtcactgacagatttgttgttcgcataccagaccgtttggaaatggatgttgccagtccgctgttgtgtgcaggtatcacaacgtattccccgctgaaacactggaatgttggccctggtaaaaaggttgcgattgtaggcgtgggtggccttggacatttggcgattcaatttgcacatgcgatgggtgcagaggtaaccgtcctgagccgttccatgaataagaaagaggaagctctggaactcggtgcaaatcattactttgcaacaagtgacccagccacattcactgcattggccgggcgttttgacgtgatcttaaatacggtatcggcaaatctcgatgtagatgcctatttatcattgcttcgtatagacgggacacttgtaaacgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaggcatacgaacgtatcctccgaagcgatgtccgttatcgatttgtgattgatatttccacattgtaataggttagtccttatatgggctgacccgcttttaatgaaactcacgaaaaacgatctcgttaagcaaatattttgaaggccggtcaatcttcctgttattctatgaatagagagttattaggagggttttttatgagcaaaaaaattgcagttcttgttacagaccaattcgaagacatcgaatatacaagtccggtaaaagcatacgaagaagctggctacagtgttgtggctatcgatttggaagccggcaaagaagttaccggtaagcatggcgagaaagtaaagattgacaaagccatctctgatgtggatgcaagtgactttgatgcacttttaattcctgggggattctctccggatttgcttcgtgcagatgaccgtccgggtgaattcgcaaaagcatttgtcgaaaacaaaaaacctgttttcgcaatttgccacggcccgcaagtactgattgatacggatcttctaaaaggcaaagatatcacaggctaccgcagcatccgcaaagatttaatcaatgccggtgcaaactacaaagatgcagaagtagtcgtcagccacaacattgtcacaagcagaacacctgatgatttggaagcatttaaccgcgaatctttaaatttgttaaaataacgagaaggcacagactgttcgggtctgtgcctttttttaaaattaagactccttctttacgttctgaaagacagcagtcgcgtcccacacattcaagccaaattggccttctgaaaatgcggaatcatttgcatcaatcacaagacgattatctaaatagattttaaagcggtcgccctcggcctctgttttcagatgatactttttattaatgtctatcggtgttttgtattcagcaatgacagaagcagcaccgttctcaaatttaaaaaatttcactaggtcatgcttcgcatccacattcgcaagataaccgtttttggcatctttgtcagagcgaaacattagtgctcctgcccctcttccgtttccatccttaatggtgatatcagattcataagtgaagtctgacccggatgctgaagacaagataaaggaatctccgtccgacctcccttgtttcccctcaatcgtgtcggcccacgtgccatttacagtcgtccagccagtcatattggacataaaaggtgacgttccccataccttttttaaagggtgtatggttaaagattttacctttacaccgccatttgcagcatataattcaagccctttgcttgatcggtctgggagaataatatccgttatgacctgctttccatcattcccaaatacttcaaccgaggagcggtcaacaaaaatgcgcatcttaaccttcccatttactggcttcaatggggctgtttcttttccggtgttaaaggccggattaaaggtgttgttgcccgactcgctccggtcaacgaacaatttggcgttccttcggtcatagccgaccttcgtaaattgattttcacctgttcggaccttaaaaccaaattcagcagctgaaccagggcttactttaaattctgcatttatttcataggcatctccagattgccccgttaacacattatgacttgcaggcgatatggtcagattcttccacttcttagaggttccgcgaatggtttccagctctttcactggtgtttggaccactctaaccccttcggtaaacgctttcaattttaactctcttggaatggacgttgcacttctccatggggatgtcggaacatcattcgcatattgccaattgctcatccaccctaaccatagccggcggctgtctgtggctggaatatcagaccaggatacagccgcataaaagtctctgccgtaatccgtccagagaactttgtttgacgggttttcatttttaaaatgagttccatcaaagtaccctacaaaatattgcatgcctgatcctcccgagaccgctccgtttccgacactgacctgcatgacccatttcttttgattcggattgccgtctaccggaagctcaaataaatccgggcattcccatactcccccgtggcttccttgatcctgtccaaattcacttgcatacgtccactgcttcagattttttgatgtataaatgaggattcggtcaccggccgcaagcaccattacccactttttttctttctcataccaaaagacttttggatcgcgaaaatcttttttacctgggtttggaatgacagggttgccagcgtatttcgtccatgttcttcctttgtcgttgctataggcaatactttgcacttgatggccttcccgatcctgtgtataaatggccacaagcggcttctctttgcctgtttgaaaaccgcttgtgttatttttatctacaactgcgcttccagaaaagatcgtgcctttttcatccggatagagcgcaacaggaaggtgttcccatgtaaccaaatctttgctgacggcatgcccccaatgcatgggcccccactgaagcccgtatggatggtattgatagaacaagtgatattccccagcataatataccattccgtttgggtcattcatccagtttgcctccggtgtgaagtgatattgaggacggtaatcctcatcatagtagcttgaatcggctgcatctgccgaaaatgccatagtcaacagcagggtgaacatgatcatgacttgaataagtctctttttcatttgttccttcgctcctctcttcatgtttgaacactttcaagagagactgctgcgcaagctggtccgtttctggcaattcttctctgtttcactgttatccgaatgatttatatatgaaaaaactgctgcaggttctctctctttccttcacacaccttatgctaagaatccagcccaatacccgagaatcccgatgacaaagatgccgcaaataatgagaagtggattcacccctttgcgaagcatccatgccaccaataacgttaatccgagaggcagcgcccccggcataatgctgtctagcacgttttgtaccgtttgaacatctacttttccgctttcatccttaatcctggatacaacgattggaatgttgatggtggtccatttggacacgagagcccccataacaaataacccgagaatcgaagcgccctctgtaagcttttgaatgcgattccccgctaaatcctgaagaatctccattcctttcacatagccatactttaatccgtaatattttgtgcttaatcttatggcattcagcaagaaaaagaatagcaaagggccggcaatgtttcctcctaaagcaagggaggctcctagcgcagctaagacaggacgaatcgttccccaaaaaattgggtcgcctacgcccgctattggtcccatcaaaccaattttcattccgcttatcgcttttccgtcaattcctttattgttcgccatttcttcttccatggctgccgtcacgccaaatataggcgctgtcagccacggatgtgtattaaaccattccaaatgccgctgcaaggcttcgtttcttttcgctccgggaccgtacaattttttgatcgccggtatcatgacataacaatatcccattgcctgcacacgttcgaagttaaaggaaccgagtaaaaaatttgaacgaataaacatgctgaaaatttcttttttcgttaatcgtttttctttctccattttttcttccccctcatcgtttaggcatcaagatcatcatcgtcatcataaacagcaacactgccactgtctgatgcggccgcgactgctctgtgagcgctttgtttttgcatcacctgctggtataaaagcgccagacagagaccaagggctccaaatcccactaagttaaaatcggtaaacgccgctaataagaaaccaatatagaaaaatggctttaaataaggaatattcatcatattgatcaccatagcatacccgacaaccacaataatgcctccgcctatttgcagtccttttgtaatgacatcaggaatatttcccaggaacgcctgaacagcgctgacactaattaaagcaacaatcaatgtaggaatcatgacgcgcaaagcttgaaacaccatcgcggtaatatgcataatttcaattccttttatatttcccgcttttgcatattgatcagcgcggtggatgaaaaagacagtgatcgtccgaacaaaaatcgtcagcgcctgacccgcagctgctaaagcaacagcgacagcaatcccttcgccaattccctgatcagcggtaataactaaaatggttgagatgacagaggcgatcgctgtatcaggtgccatggcaagcccgacgttcatccagccgagcgccatcagctccagtgtgcctccaagaataattcccgtttttaagtccccgagcaccaagccaactaacgtacaggccacaagcggacggtgtgtctgcccttcatccaatacacttgcgattccggtgattgctgcaatgattaacaacaaaataatttgtaatgaagacatattctcatccccttgattattttgttacgttccgtaaaatctgtacaaaatcctcactggcatctgaaggcagctgcctcaattccagtttcacgcccttgtcacttaatgtttcaaatgcctttatatcttgttctgtgacactgactgattttgtgatttgcctgcggtgattttcaaaacgcattccccgacgtttacggttttgatcggtacacctgcttctataagagatacaatatcggacggattttcaaacaagagcattgctgttacgccttcgtagcgcggactatgaaatgcttttgccattttagaaaccgagacggcactcgcctttacatttgaaggcgcaacagaaaggatcagcgtttttctcatttcgtcctgagcaatatcgtcggagacaacgatgattcggtcggctgcatggacttttatccaccttgtcaggatttggccgtgaataaagcggtcatcgattcttgctaacacaatgttcatcataattcatcctctcttgtatcttgattggctgtttttactttttctaaatgttcactgcacacttgaaagctttgctgactcattgcttttaagttgttcagcaaatctttgagagccagatgttctctctggcttaatacctccagcagaatcggcaggtttacgccggctgccatatccattctttgatcctcagcaataaaggaagctgccgcgttatatggcgtccctccaaaaatatcgactaaaaaaagcacttcatgttcttccgggatatccttgagcgcctgatgatatttttcttgcagcgtttgtattccttcccctttaaaaaacggcactgcaatcaggttattttcttcaccgaatatcatccctgaagattcttttaacgctatgggaaaatctccatgaccgctgataataactgaaatcatatctattgctcctttcctgttttgtacatccatatataatgcaaggatcgtgccaacacagttgtgttaagcgttttcattgttatttcagccaatagcaatttgttgtcgaaacacttaaaacgaaaaaaataaacctgtattaaaatggtgttccatttaatacaggttcatataaaaaaactgtttttaaaacagctggccatgcacttcttcagcaaatatggcggctataaataatttttcatcatcacttatgcgaagtccgagcttttcttcataaggggctaatgttcgctctgtcacgtacaccatttccttcagctgatcattgatctcttcttcctccgagaaagcgatcggattctgcttaattaccctttcaaaggcgaaagccgtgtgcataatgactttgatcaaaaccgcattattgaaaatgacccccagctcatcttgaacggtttgcagccactccaataacatttcgatcacatggtggggattcaagaagacaaggtattttttcaggctatcctcgcaaagctccctgacaataatatttgcttcgttcaatccattgctcaaggggatgcttccttttgtaatcgcctgttgaatcagcttctctccctccccttcaattaacacttctaaagatacatgcggagcattgattttagggtctttcgttccgactgtcgcaaggatttcatactctttttcgatttcttttatgctgttggccagtttaatcgatgatacggtcaatatgtgaatcggggtatcggaggccttgtttacgatcgtggttagaatgtcttccagctttttggccgttccgctgcccgtcgtgcagatggataccaatgccttctttttgccggatgccgctggctgacgctcccacagctcgataaaatccttcgtgaccgattgatagatcgcatgcaaatttaaattcaaatagttgacctttctgacagcatccagcaccattgaagtcgtaacattgctgatcgttttgatggaaatgcctgtcttttcctccagcctgctttccagcattgcaagcgaccccatgtctaccagcattaaaacaccttcgccttcatcaacctgtttcattttttctgctacgcattcaagaatgtccgaaggtgaaacagaaagcggcatatcgactgctgcaatcggcgtgctccctagcagttctgtcgcaacttcaaccatcgaactcgccgtgctgtttccatgcgcagccacgatgataccgactcttttgttctcctttaacgatttgatggaatgaattaacatcgttaagtagatgacttctatttcaggaatagccactttaaaatattcctgaattttatctttaaaaatcatcgccacccgatattctttcacatgagtatcacgaatttcatctgtctcctgtgtattcaaaacatcaatttgctttcctcgctttaaaaatgcgtcaatatgcatactcaagaaataaataaacttacggtcaaatgtgcaatccagctcatgttcagctatttcttttaactgttttgtcatttgaatcacatcatcttcaacgaatgtcagcaggttgtctttttgaaaagcttgatgatgaaaaaaacttctgacatgcaaatggacatcagtcaagatgtactggttaatatcctttttggataaaccttctttcataagcgttttcactttttcctcaatcaaatgatataagttaaatgagaggtcttcgtcaatttttgttgtttcatcttctacaatcggagagataatcgttgtaatattgacatattcagaaatggctttgcttctttgcatgtttttgctgctggacatccattcttgcttgatttcatcaggcagatcgcgaacagtcagttcaataacttcatttctgtcaaggttatgcaaaaatccgtgtgcgcaaactaactggacatttgatttcagctgtccgacattcccaaatttcgcagagtgaataagcgcattatagacatcgatatgcacactcagattcttcttaattcgctctgcttctttccctaataaaaacgtcgtcagatccactctttctttaagcgatcgttcttcaagcgaaggaatatgaatggtcattgggattcttcgcaaaaacgttttcaatagtgcagaactcggattttctgtagtcgcacaaataaacaatacgttcgatgttcgtttatgttcagattctccaagcctgttataagaaccgctgtcaataaaataaaacagcatttcttgtccctcgggagggagacggtggatttcatccataaaaagaatgccccattggcctgttcgactaaacctgccttatcctcggcagcacctgtaaatgaaccttttttgtgtccgaataattgagaaagcaataattgagggttgttgtagtagtctgcacagttaaatgtaataaatggtgcgccggccttcaatatgtcagagtaaatggcaaactggtaaattcggttcgcaaaaagggatttaccggaaccagtcggccctaggaggagcatatgcagaccgttcggcggataaaagacagctgcttttgcctgggagatcgctttcttcaaactcccttttgcccctatcataagctctaggggattcgtggaaatgtgttgatgattttgctttgaatttccggaaaacgcctgaaggtctttcacttccatcatctctgtatcccatttcttgttgaataatttttctgctatctcgactgggatgtatcttacaggaaacgttttaattttgatgacctttttggaccggacgagattgttcaattcaaagctgacattggaccgctccattttcagctgctcggcaatctcctttgctgaattcccttgtatttttaatagatgatctaaggttgaatcttgaaaattatgcatgagctgatggtatattttatctattcttctcacgtctatcatcctttgtccttattagataagccattaacaagaatatttcgaaactttatagtccgcgttgagattatctgctgatacacgttcaaaaaggtctctatagcagattgacaaagctggcttttatgcatatatgtttacatttcgaatcatttgcaactcatattagtatgatagattcgcagttctggagggccagcccccttcaaaagtaataatcagtaaacagtttatcattcttggggaatgtaatgatgtcaaaatcatcaatgacaaaaaatgaatcttatagatcaggacatttttcctaattataaccccttaagttcgttcacaacaaaaaagacggacactctatgtgaccgccgcagtattacaatatgcaaaacttcgtcatttttgcaatccaccttgaaggctaaggaatctgtaagcttaaaaactttatctccgattttctcgatttgatcccccctgcaggcctcaaacatagtgggtatgcaattatacaaatcgttaccgattaaaactagcctgtcagattgtccaaatgactttcctgttttactttgctattcaggtagaatcacgagtgaaaaatagagccagaagacatgtaacagcacttaaaatagttttaaaatttaaaaataaaagtatctattcttttaaatgttataatatccgataaaactttactcatctttttattactggaggaaaataaaattgataggcaattctagcaaagacaattttggccagcaacagaaattgtctagaggccttaaaaacaggcatatacaattaatggcgattggaggtgcaatcggtacaggtttatttttaggttcaggtaaatccatccactttgcaggaccatccattttatttgcttacttgatcaccggcgtattttgctttttcattatgcgctcgctcggagaactgctcttatcaaatgcgggataccactcttttgttgattttgtaagggactatttaggaaacatggcagcatttatcactgggtggacctactggttctgttggatttccctcgcgatggctgatttaacggcggtcggcatttatacgcaatattggcttcccgatgtgcctcaatggctgccgggtcttcttgcgcttattatcctgctgatcatgaaccttgccaccgttaaacttttcggagaattagaattttggtttgcattgatcaaagtcattgccatactggctctgatcgtaactggcattttcctgattgcgaaaggtttttccgcagcttccggccctgccagcctcaccaacctttggagccacggcggcatgttcccaaatggatggcatgggtttatcctatcgttccaaatggtcgtcttcgctttcgtgggtattgaacttgttggactgacagcaggtgaaacagaaaatccccaaaaagtgatccctaaagccatcaatcaaatccctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcgtcagctgcaaatagcgctttattcagcacaagccgaatggtctattcacttgcaaaggatcatcacgcacctggactattaaagaaattgacttcttctaacgtgccaagcaatgcgctgttcttttcatccgtcgccattctgattggcgttagcctgaattatttaatgcccgagcaagtcttcacactgattacaagtgtttctacaatatgcttcatttttatttggggcatcacggtgatttgccatttgaaatatcgaaaaacaagacagcatgaagcgaaagcaaacaaattcaaaatgcctttttacccattatccaactatttaacacttgcatttctcgcgttcattcttgtcatattggcactggcgaatgatacacgtattgctttgtttgtcaccccggtctggtttgttttattgattattttatataaggtgcaaacccgcagaggacataagatgaaataaagaaaagacaagggatactcactcccttgtcttttttatagggccaaacactaaattaaactttggtttcaaatttcattcacttcatttaagtgttaactcaaaccagttttgatgccgaaacctactaatattattccggtaattttttgaaacactttctggaacttcgagtttttcatccatttttttgcgtaatcaataatataaacaagaaacaggaaccacaacaccgctaataaggttaggattgaagctaaaataatgagctgctggtttatatttccgttcaaattgataaattggggcatgattgtaacatacaccaaaacagttttaggattgagaatgttactgagtgatccttgcataaaggaagttttataataacgtttcggagaacttgccatattttttgcttgggattgcatgtcatctaacgaaaacatacttttagcaaaaaaactttttacacctaaataaattaagtatgccgctcccaaatatttgatcgttgtgaaaagaatcactgactttgcgatcaccaccgataatcctaaaatggcaatcaccgtccaaaaggaaagtcctgttgccaatccgagaatgttataacggccggctttcgggccatacctaagcgtatttttcatcacaagcatcgtatctgccccggcatgataaccatcatggcagcgatcggtatgtatgcgagtaagctgtgcattgttctctcccctttaaaaatcccctcaatcatatagtgactacaaaagtaactacttataaaagtgtatcaatgcgtttggaataaatcaatatggtttgttaaaatagcgattactaaggcagcgattgctctttatattggaggatatatgaaagaaaatatgttagacattttaaaaaacctcaattttacagaatatgaatcgaaagcgtatttggcattattgcaagaatcacctttaacaggctatgccgttgccaaaaaatccggagttccccgttctaaaatttatgaagtcttggaaagccttgtcataaggggagatgtttttgtcagtcatggaaatacgcctcagtatgttccagtccccgcaaaagaactgattaaaaaccgccggctcaaagcggaagagcattttgatcaggctgagaaatattttgaaaagttcgagcagactgctaatgaccgggaaaacatctggaatatcaccggccgcagtgaaattcttgaaaaggtgaaggcttgtatcttatccgccaaaaaaagaatcctcttagaaatatggaaagaggattttaaggagatagaatcagagctcaaacatgcggcagaacaaggcgttattgtcaccattattgcgtacggagacatcgtatctgattttgccaatgtttaccttcacgatatgagcagtgaaattacagaagagtatgatggacggtggcttgtctatagcggagatgattcagaagtagtagcgggcattgtctcacttggcaacgacagccgtgctgcatggacgatgcatgtaggtttagtcatgcctattactgaagtgatcattcatgatctgtacctcatggaaattctgaaaaagcatagagagcttttagaagagagcttcgggaaaaatctcatccagttgcgccgtaaattttctattcactcagatttcaaaaaacattatttggaataatattcgcatcgcttaaccaaaacatggcttgtacaaacaagccgtgtttttttatgcataaaacccccatgctgatttacttctctcttttaaaaaaatgcgattctgcgcaaactatttttcagcctgcctcgtctatcctaggtaacagcctacgatatacgtatattcaaaaaggagccctttattgtaatgaagaaaaaacaaacaacaaaagcgttgcttgtcacatgcataactgaccataagcaagatttctacaggttggctttcagttatgtgaaaaatcaagatgacgcattagatattgttcaggaatctataaaaaaagcgctgagctcagttgaaacggtcaggaaccctgagacgataaaaagctggttttataaaattttagtacggacagccattgattttttgcgcaaacaaaaaaagataagagtgatggacgacgaaacgatagaatttttaagcaaaggaaaggaagaccattacaaggatactgatctccatgaagcgcttgacgaattgccgtaccgctataaaaccattattattttacgcttttttgaagacctcaaattagaagaaattgcggaaatcacaggagaaaacacgaataccgtcaaaacgcgcctatacagagcattgaagctgatgcgcattcagttgacgaaggaggatctttcttaatggataagagattacagcaattaagagaagaatataaaaatgttcagattcctacagaattggatatcattgttgaaaaagcccttcagcaagaaccaaaaaagaaaagaatcgtcatgtggccgacatcagcagcaatcgctgcagctattttattcactgcgcttgttaatatcaacccggacgccgctcaggctatgtcaaagatccctgtcatcggcaaaatcgtcaaagcgatcacctttattgaaatcaaagaggaaaaaaaccaatcaagcattgatgtcaaaacacctgctttgtccggactttctaataaagagcttgaaaacagcattaaccagaaatacttgaaagaaagccagcagctgtataaagagtttatacagtccacatcccaaaacaaaaaagggcatctcagcatctacagtgattacgagacggtcacagacacgccagatttactctctatccggcgcaatattgaaacaacacaagcatcttcctacacacaaagccgttatattacaattgacaaaaagaatgatattttacttacattaaaaagcttattcaaagatgagcgctatatcaaagtcatcagtcaaaacatcaaagaacaaatgaaacagcaaatgaaggaagatccaaataaaatatattggctcactgacgaagatgcagaaccgttcaaaacgattcttcctgatcagacgttttacattactgaagaccataaacttgtgatctcatttgacgaatatgaagtcgcccccggctatatgggcgttacagagtttacaattccaacccgtgtcatttcaaacttgctcgtgggagaacgttatattcgataaaataaaaacatccatctaagattatggatgttttctctcttctctattcgaggtcgtaacctcgctatcaaaaacaacgagaatatttgcatactattggaggaatacccatgtatcacaagacacagcatcatcgatacatccctggacttgatggccttcgggcttttgccgtcctgtcagttatcgcttatcacctaaatttcaattgggctaacggaggttttatcggagttgatatcttttttgttttatccggatatttgattacatctattctattaccggcatatggaaatgatatcaatcttgattttcgggacttttgggtgcgccgcattcggcggcttctgccggcagcgtaccttatgatcttttccactgttgtgtgggtcgtattgtttgatcgagaactattgcacactctacgtggagatgcgatctcttctctcttttatatgagcaattggtggtttatttttcacaagctatcatattttgatagtttcggttccccatcacctctaaaaaacctttggtcgctggcgattgaagaacaattttatatcatatggccgatgttcttagttgttggaatgtacataatgaaaagccgcgccagattggctgcggtgatatcattgcttgcgctttgttcagccgtgatgatgagcgtactgtatgaacctggcggagatccgagccgcgtttactatggcacagacactcgttcgtttggacttctcatcggatgtgccttggctttggtatggccgatgaaaaggctgtcttccaacaggctgcctagcaaactgaagcacactttgcacgccactgaattttcggcattttgtattttagtgttgtgtgtctatttcacagatgaatacgagccttttctttacagaggcggaatgctattcattagcgtgactgccgcaatccttattgcatgtgtttgccatccgagcagctttttaggcaatctgctttcatggaggccgcttcggtggcttggaacgaggtcttacggaatttatctttggcactaccctgttattgtgttaagcacgccagttcaagaaatcggaaaccctgttttttggcatatcgtgctaaaggtcattgtgacatgtatacttgccgagctttcctatctttttattgagaagccggtacggacacagggatttaggtcatttttccgccgtgtttttatacatagaatcaaggaatggaaaacgacatctgtcatcagcaaaatgtcaattggtttcgtcattttcgctatacttatttttgcaggcgggctgtcagggctagccggagagcaaaagcaccctaccaaatggacctatagctcacaagaaacaaatgctgacaccagccatgcttctggggataaaaagaacgctgcagcagataaaaaacacaatcctgaacaaaaaacaacagattccattcagggtcaaaaggaaaacaaagatagtgggcaagagactcataaaaagaaagacacgcaatctcaacagacgaaagaacccgcagatactgcgaaagaggtgttagctataggagattccgtcatgcttgatatttcttcacacctgcgtcagtcactttcacatgtgacgattgatggaaaggtaggaagacaaatgtctcaagctttggaactcgcaagggagtacaagtcttttaatcagccgaacaaggctgtcatcattgagcttggaaccaatggctactttacaaacagccaaatcgaacaactgcttcaatctttctcaaaagcccatatctatcttgtcaatacacgggttccccgccaatgggaaagcaaggttaatgaatctttacagcaccaggcaagcgcacatcaaaatgttacgttagttgactggcatacagaagcccttcagcatccggaatattttacccctgatggtgttcacttggttcctaaagggcaaaagctttgaccgctcttattgttcaggcgatgaaatcataaaaaagagatcctatgcggatcactttttcactttagtttctgatcgttgattatgtctcctttcagcaaggctgcccttatgtttacattccgtttacgtaagggtaagccaaaatagaatggagggatgataatgaaaggaaataaagaacatgacatccaaaaagagctgaaacgatatgagttttttttccaaaaacgatataaggttctttatacagtaaacgattttatcatcggtgctatgtttctcgttggaagttttttctttttctatggccaattatttatcgaaaacaccttaagtgtcaatacaggcacatcaagtcagcaaaatgacagattcttcactaagtaaaatggcttttattgtttttcagcctttatcgaattggacaaatgaaaaataatacaaatttaattaccagtcggaaattcgcacggcctcaaatttgtgggggtaacaacttttactgctcgagctatttatctcacaatagctcttaaaagagacgaaaaaagaagtaaagagtgtcgacctttatgtttttttcagcaaaaatgaaaaatcagaaatagcaggttgatacggtaaggttgaaaatagcttcacttgtaaaaggtcattaaattgcactttttaattgtgctgttctgtttgtcgcaatgaacaggcaaaatcaatgttcaaaataaacccaacacccaatgaaatttcacagccatcacggctgctgtcccttttaagatttttactaggggcaaaatacaccattgatgcatcaaaaaatgctttaataaagagacacatcattcattcttatttgaccaatcggaaagtaaaaattgtattgcttactgatcgagtagtaaagtttttctgcgagtcacttaaatataaatttatttatactagaacacttatagtataaggaacggcgagcttttacagggaatgttgggatttaggtgtaccagatcatagttagatgtaaagtgataaagaacatgaatacaggatgaatcaattcataaaaaagagctgttttcagaattctgaaaacagctcttttcttttaattatggtgctattttttaagtagtacgctcttcgacacgttctttcattgtaaaatccctccctcgttacattttatcaagattcagaatattccaaaccccgatattgtcactataccataactcatttcattttactaccttttttttaatattttgtttatttattacaaataatgctatgaatttcttctgacattctaagtgtttctttctctttttccattattaattcgactttgtcaagcattctctgaattaaatttaacctattattcatagttgattttagaaccatattcgccgacactttccaatcttgtcctataaataaataagcctctgctatattttttatttcaggataataaacagaaatatcaaatagataatcagcatatttatatctagaatttgaaaccgccgataaccccctatatatttccataattttttcttcagactgattgaaggtgtcatcaatattatgttcgtaataaaaatctaaaaatttttccaaacccgacaacccaaattctttaataacacccggtacatcaggaatattagaggtagatattattcccctcagattattattattatgtttaataggttctaatagtatttccttagttaaataattttcttcaggtaatttaatatacatgtatttaagattcatagagtttgcctctatcagctctttaggttttagttctgctattgaaccataagcatcatcaacatatgtaaaaagactttcttcataaccgataattgtgattatatgaggagtgtgacgtgtttgataatacatatttcctctcgtatagtatgtatcaactgggacaagtacaggttcattttctcttagaagattgattattccacttaaaaaatcatttttatatttatgtttaatagtctttactttaatattgtgtatccactctagctcttggacacgggttaaatatgaaccttctaaattaccaattccatacttttcatcaatataataaattaaccctgattgtttccagactgaattagaatggggataattcttataaaacaatatgttagttacacttaaattcatacaatcatatccagctctattatatggtttaatatccaatatcattataaccacccatccttctcaagtgttaaagaaaaaatatgcatactgggattatcaactagtaatatgcttttaaagagactattacttggaattccaacaacagaataccatatattagtttttactgtcctagtataaccactcttatttgagttaataccttcacaaataataccttttttattattaaatttaggcgaagactcaatccaatctgttaatccaatttttacttctttaatatcatttcccacaagtttaataggttcaataaaagagccattatcagcggcaccaagaacatgtatattgctataatatgcttctttaatttgaatttcttgattcataaactccaaattgtcaacaactaaaggatctttatttggaaacaaaaagggcacaccatataattctaaaacacttctagaagatgggagattttcagaaatataacttgatccaaatccagtaaaattagcatcttgtggattattcattctggaaatccctttattattaaataattcttctaaatttatcatttcgtatttccccataaaatcacctttcttagaaaatatacttatttaatttgtttaaaagttttcgtctgtttttgcaaaatcatttcctcttatctttccagttaagtaatctttaactgcctcatcaacttttttatagtgattaagattaaaagttttttctccaaaaatgggggtatctattagatttaattctgaatgtgaatgtaaagaactaacaatttcctgaacataagcagaacttgacaacttagcgagggtgaaactttctcttaaccctttaatttcatttacattttcgtctataaatatactggtcttatgaacacaaaaaagttctgaaattattttattagaatttactttccaagtattaattaatctttttcttccataaggcaaattaactttataaactcgacatatgtccatatcccaatgtggtttatcaaagatcagtacaaccatatatgtcactattccttcactatttgctagataaaattgtacatttcgcctgcgtttttcccataaaaatgaacttgatccattaacaagaatctcatttccaatttttaaattaacattgatagtatctaacacttgctttcctgatattgaaaaatcactataaacataagtacctccgagtatttcaaaaggtgtaccaggtttaatattactaatcattaatattaaatcaattgggtgtgatatctcagatgtaactcctattgtaggtctatgatcgtataacctgaactttccccaaaaaaaacttgccctttttacagtaaggttgtttgtttgcatccaattcaacaaatactttaaaattaaactatgtctctctacaaaatgcacagcaatttcattttcatcatatatagaaagtatatctctgacttgattaaatttctcaaccaacaatttttcaactaaaattcttttatattttgtagaatatttctttatatctttaagtatattaaaatggctattctcatttgttgctataactataatatcgtacgccccatttatgagaaggtcattaactttttgataagtttttatatttgtattataaaaattttcaagtctctctctatttctatcacaaattgcaactagttttacatcgcctttaattttttctctatataatatcgctcttaagaacctgctgcccgcacttcccataccaattaaagcaattgatagcataatattaagtccccttgaatagatgttttctttttattcttccttagatagataatcagcaaggattaggatccctttttgtaattcagctatatctattttttcatgagctgaatgtgcatcagagagatcaccggcaccaaaaattaaagtgggtataccagtaaatctttgataaagatgtgcgtcacaacttacacaccatccatagctttcttgttgttttattccatttctatttagtgaattcattaagcttactacgttcgggtcatttttctcgatcaggtaagcactattctttaatccttcaaattttatacaaacattattattagtccagtcatcatttgtatctctgcatacttttgttattttttcttttatatcttcaatagagtagttcggaagaaaaccaatattacaaataagctcgcaatattctgggacggatcctgcccactctcctccatttatttttcctatatttatttgtactggcatatcccatatggaaaatgcttgattgttttttgcttcttctagtaactctagttctaagcacttaagtcgatttactatattgtaagcactttctatagcattgacacctgtttctttacttcccatatgtactgccttaccttttacggtaatattcgctgttatacaaccacgatgtcccctatacactaaaagatttgtaggttccatcacaattatagaatctgcctcgacaccatgcagaatagaagatatagttccattactactgacctcttcttcaatcactaaatcaatagctatttctttatttattttaatattgttttcttgcaaaaacctaatagcttctattagcataattaaattactttttgtatcacaagcaccgcgtccatatatgtaactatttttaatgtatggagaaaaagcatgaggaaagtctactgttgctgggacaacatctatatgaatattaaatagcacactctttaaactattatttttactgtatttaaacgctttaatattaaaacgttctgaattaataactgattggttggttttcacaaaagctgagtgaagttctaaatctttatgtaaatgttgtttttcaattataaagccaacttcgtttagatagtctcttataaaatttaatgctctatgttcatgtggtgaagaagtatctatacttaaataagaaaacaaattacttattatcctatcttcattttgataaaaccactctttaaatttcattttcattttaacacctcattctttgttgttattattctgattgtctgttctattaaatttgcattcttgcttgcttcttttctatccttccctgttacaataatataaccaatgccttccgccatattgcgaggttttttcacaatatctcctacagagtatggggaaacttccaccacttaaagtcataataacctggtaaatttttaatttcttctaaaccctctatattagttataatacctggttgtgcaaaaattgttctatttaccatacccttttcatattttggattcaaataattgtaatcaatttcttcatgtagtgcttgttgaatagcagctcggaggatattcgtaccattacttaaaggaatcatctctgtaccgaagcgaggaccaccaagcctaggcgtaatttcaagaacttttatttgtttgttatgtaatataagatctccttttacaatcccatttttaattcctaaagcaagggcagcttcttcagtaactttagaacacatccttttttcttgatccgctaaaagtgtaggaataatgtctccaacttccacaaagtggggcttgtacttttcataatgaaaaactcgttcggaaagaccagttaaatgaaactttccatctatcattaaaccttcactgctgtattctgttccttttaaatattcatttactataacacttttttcattagtagcattcgtacagtatttataggcttcataaagatcttgtttactttccacaagtactacgcctatcgatccgtatagatttataggttttagtactaagggaaactctacatctattgccctttccaataattcagcataactatttacgattctatatttaggtgatggaatattattctcttcaaaaattttacttctatttgattttatagttgaattaactgcaacttcataaggaataccgaataaattaaaatgttccgcaatgattgatacagatattgctgtatcaatacataaactaaaaacagcttcaaattcatatcctttttcatataggtaacaagctgcttctaaggcgctcttaggatcaataggatctgctctaacgaatttagtaatatactgcatgccaatatcatgcttaaactctgctatcatataaatttcgtagtctttgttaagatcttttaaaatctcggcactatttccattaccacagaataaaattcttctttttctcaatttataacacctcattatctatgactattatttattgatatcgatacttgttatatcatccaattcctttaataatgttgttttttgtactaagtatttcaattcttcaataaaaggggtgatcgaagtatcgtatgatagataaggtacaatctttcttacattatcataaagaactttggttgcatttgataggttgctttcttctcttatatcaatagcttgacaagcacataaaagttcaaaactaacgatatataaagtattctctaaaatttctttacatctccgtgaagctattaatccaaaagagactatatcttgaaaatctccagttgatgttaatgtttgtattgataatggtgtgcataatgatctattttcagcagtcagggaagtactcataaattgaccacccattaaacctaatcttaatcctggattttcttttgttaggaaagcaggtagaccattactatttgacttatccataaatctatcaattcgtctatcagacaaattagataatgtcgttaagcaaattgataagtagtccatagccatagagatatattgcccatggaaatgtccattatgaaaaacatcgttttcctctggtaaaatcaaaggattatcactacttgaattgatttcattttctataatagtcgatgcaaattcaacagtttcatataatggacctagtatctgaggagaacatcttaatgaatacgcatcttcaatttgattgtctaaatgctctacaacattttttttcttttcttgaatattagcctctgtttctgcttcatctataacaaatttacttgattttaaaatattataaattttagttgaaaaataattctgtcctttatggagttttcttttatgaactattggatcaaaaggtttaagctttgtagcaagcccttcaaaagtcaacgcagaaatgtattcgtaaaagcctaaaagttgttttaccccatcacttaccatagcacccgtacctgccatagccgaggttccatttataagagctagaccttctttgtagcccaatttcatttttttaattttagctttaataagtgcttcttctcctgttaaaacttcgccttcaaactttgccttccattttcccactccaaccaatgctataaacgctagaggccctaagtctccgcttgcacctaaagatcctttttttggtatacatggtattacatttttgtttaacatattcaaaaatattttgaaattctctaaagatattgcagaagcccctttagatagagaaattaatctcgctaacattgtcgcccgaacatcttcatcactcatatattcgcctacatttgaggcaacagaggatattaaattattttgtaacttttcggaaaattcgacagggactagataatctacaaatcctcccatacttgttgttacaccatagattatacgaccattttcaacatattcatccaataattttctagacgctaaaattttatttttcacttcatcatcaatttcaactttcaaatctggctcttttactattttaataaaatcagagagacttattttttggttggataatacaaattttttaaatgagtaattttccattaaattatattcctcctactagcttaagttaaaattttttatgctttgagtaaaaatcatacaatctaggtaacatttcatttcccaatcctcgctctatagcttgttgaaaaaataaaataaattcatcaacaataaatagtttactctgttcttcttcattaattatttctttaaaatattttaaatctttataagcattgttgattgaaaattgtaatatactttcttccttattattaatccaattaatcattgaaggtaaagtagatatataattagaacctttggacattatctcatcaagtttattaacatcaatgttatttaatttagctaatgccaaagaagtaataactattcctgtaaaccccatagaaatgaaattgttaaatagttttaatttgtgtgcttcccctaatttgcctatataaaaaatattctccgaaaaacagcgcaaaatgtctttatttttttcaaaaatagtatagtctccaccaaccataacatttagtttaccctttattgcttcttcagggccttttgttagtggggcatcaagaagggttacttgtttatcctttaaataatcccctaagatttttgttgattctgggcgggatgttgaacaatcaataattacagcattattccttaaatgattaataactccatcttcccctaataaaacttcttctacaacccgagagttaggcaagcataatagaattgtttcacatttaagagcaatatcaattattgaatactctagccttgcccccatctcctgtaacttttgaactttttgactatttctgtgtttaattatgtgtaaaaagtaccctgcttttattaaatttaaagctataccgtagcccatatttccaattcctataagaccaattcttttactcattgtttttttctccttactcaaactttttattttgtatcctatttaatcttatatatacaaaatttataatatcttctatcgttttaaatttatcataaattaaaaaatcatcgtcaaactcgatttcaaaacgtctttcaatttctgaaaccattttgataaatcgtaccgaatccataccaatttcactaattttcaaagttttattcttaaaatctgtctgtaaaatatcatttataatatacattatagtttctttataatcacttttgtgttctgaagtttttcctttttgaataacaagttctttaatttttttccgatttattttcccgttaacgttcataggaaatgattcaagacaaatgaaatgactaggaaccatataaattggtagtttatcaagtaaaaaagatctaagtttctgttcatttattgtgttattacttgtaaaaaatgaacagatccattgctcgttattcttatctctattaatttctgttacacattgttttattccagggtatttaatgattactttttcgatttcttccaattctattctgtatccttgaaacttaacttgattatcctttctacctaaatatttaatataaccacttggcaaaattacaccgagatcaccagttttataaattctattctcactaattgacggaattgagacgaagttttttttggtaagctcaggcttattaacataacctttacctacacctatccctgatatataaatttctcctttttcgttaactcccagtttttgttgtttttcatttaaaatgaatacattcatatttttaataggctttcctatatgaatatcatttgctttagttaaattgcaataagttgcaaatgcagttatttctgttggtccatacagattataaatcttagcactactattagttttaattaattcaagtagattataggatatattttcagcacctaatagcacagtagttagtctttttaaaaaaacataatcgttattgtaactaaggaggtattctaatcttgtaggaggaataaggagtatatcaacattgttatttataattaattttttcattaaaacagggtttatttgctctttttcattcgcaagcacaactgtcaaacccttacataaaggtaaaatagtttcaggtactgacatatcaaaagaaatatttgatatgcaggctattgttttcccaaaatttattccaacttcttctgttccatttctaattaaattcattaacgactcctgtgttatcagaacaccttttggatcccctgtcgaaccagatgtataaataatataggctgtatttttcatataattaggtgaacttttttgtggaatatcttcagtatatgttgttatttcttttgctttagacatatttataattttcttgttcttaatgtaattgcaatcttgatcagaaacaacacattctgatccgctatcttttattaaataaataatccttttttcgggtaatgttggttctatggggacataagttgcacctagcttcagtaatgcaaataatgtagcaagtagctcaggagaccttttcattattatacttactattttacctgaatgaattccctctttttctaaatataacgctattgaatccacacggaatagaaactctttataagtaattctctgactttcgaatttgactgctactgtgtctggatacttaaatgaagtcctccttaacaaatcatagattgacagttccattttattaccccccttaaattaactgctagcgctgctataattctttattgcataattccaaaatatacggactaaaacaaaaagaatgatcgggacaatataagcccatattaaaagcgtattagaaatcttgccaactaagaacattgaaggaaaatttgagattgtaaaaataggtataagaaaaatccctattctttgaattatttttgtataaattaccatcggcattgtattaaaatcccatgccttatctgatatattaaatatcgcctttgtttcaataatccaaaaagacaaaagctgcggaatcaaaaataatgtatacgcaacaattactcctaaaaaaattagtaatatataaccaagaaaataactaaatgttaaatctatatttaattttaaaatagccataataaccattgccgttccacctaaaaagtttgataggatcatagaaaagtcaattttcctaagtgttaacataaactggagggagactggttttattataagaagatctaagtcacccttttttatgttattaggtatttcgtaaaaattaatcattataaatccagtatagaatgctgttattatagaaaaagttcctacataaagtaaaatttcatctggtgagtaaccgttaatagtaatgtctagattataaataacaataagatacataatttttgtaaatataaacccactttctacaataaacccaatgaaaaaattccatctatattccatttgagttattaaactaagttttaaaaattgaatatatacaattaaatgcttattaactacattaattaatttactcattagccacccaccgccaaatatttgttcataccaattttccacaaagctttaaggagaaaaaagtggataactatccatactaactgaattagaactccattaagaatcatggaagggcttaatcttcctgttattatgtttatcggaaaatatactgtatatttaaaaggtaaaaaattaagagcatagtttaatctttcaccaaaaatatctaaggggaatattgaaccacttataattaacgttaaaagattgactccccaaaaaagcattgatacttcttcaaaccaaaatgctaatgaacttatacaatagaaaaaaagaaaattaagcaatatagataataatataggtataatcgaaaaaaatatattgattatatttaaatctaaatccataaccgagttaatagtacataataagaatactgaaagtattattgtaactaataattcgctgcatttttgtcctaaaaaacaactacttctaaacttaaaataatttattggctgaataagaaatttacttaaacccccatcctttatatctagtgcaatatccctctcaaaccctgtagatactaaattcgtaaccaaagcagccattacggtatatataattaactcactataagtataaccaaaaactgttttgctactagtattttcaaaaatagaagaccacaagtataattggattactaaagtgaaaaatcctccaaatatattaagaaggaaattagttctatactccattgaattttgaattcctaatataaaagttttcttatattttagcctctttctcaattttaatcacaccttctttcctatacaataattcaatgctctcttcaattggaatattttctatggtgaaatcttttattggaaattgacttagaatggataataaatcttgattaacaattttattttcaacttccaactgtacattataatcatcatacatcctaatatttccaagtggagataactcatttttattaaagttttctgtgaaatttagatttattagttttttattgttaaatatctcatttattttatataaatcaccatcataaactagctccccattattaattactataactctatcgcacaattcctctatatcttccatataatgactcgttagtattattgttgttttgaatttttggttataatctttaatgaatgctctaagatttctttgagtaattacatctaaacctattgttggttcatcaagaaaaattattttaggttgatgtattagtgcagcaatcaattccattttcattctctgtcctagagataatcttcttacttgaacgtttaataaatctttaacttttaataattcagccagttctctaacaattaaattgaactgtttatcatttatttcatatatatatttattaagatttagtgattctattgcaggtaaatcccaccaaagctgactcttttgccccataattatggagaagtttttcttaaactgttcttttctttcccatggtatatagccgcttactgtagcggttccttcagatggataaagtattccagctaacatttttaatgtcgtagtttttccggcaccattaggacctaaaaatccaacgatctcaccttctgaaatacaaaaggacacattcttcacagcttttttgactaatttctttcttcgaaataaattttgaagtgaagattttaccccaagctcttttttataataatcgaaatgtttagacaaatctttgacttctataatcataagaccattccttttcacatttagtctcataaggcaaccatcaacaaatagagaagttttgttaaccaaaaacaattgttataaataactcttttttaatatatacaaaaacatttacatattaatatttttatagattattcttataccaatcaatagttaaccgcaaaccagttgcaacgtcataatcaggtttataattcaataaattcatagctttatttatatctgcatttgaatgtctaacgtctccaaccctatccggaccaaacttaggaactatttcttttctaagaattcgagagatatctgaatatagctgaattatggttttctgttggccgaatgcaatattgaaaaccttgccaaaagactcttctttagcaagacaagcttttaaattagcttggactacgttatcaataaaagtaaagtctctagtctgtaagccgtcaccattaattattggcggtttattatagagaagcgtcttgatgaattttggtataaccgcagcataaattgaattagggttttgcctctttccaaagacattaaaataacgcaaaccaatagttggaaaatcataaatctcattaaaatttttcgaataaagttctttggtaagctttgttattgcataaggagacaatggattacctattctatcctcaatttttggtagatttaaatcgtcaccgtatactgaagaagaagaagcatatacaaatctttttactttagcttttttagaggctacaagcatatttaaagttccgttcacatttacatcatttgtttcaattggtttgtctatagatctaggcacagagccgagtgctgcttgatgtagtacataatcaattccctcacatgccttttgacattcttctaaattacgaatatcacctttttggaggtcaaaattagagttgctataaaaaacttcaatattttctttattaccagtagaaaagttgtcaagaacccttacataaaaccccatttctagtattttttcaacaagattagacccaataaaacccgctccaccagtaacgagaaatttggaattttcagggaaatcatatctattattattattattcaacttaaagcctccaatagagaaagtttttattctctacttcttctcgattaaaaatgccttttaaatcaattaaagtatttttttttatatttattttataattttgattttgcacttcagaggaagttgcagcttccataattgcagcttcgaaagcaacattattgtatacattgattctatacatatttgaaatatcagttaaatcaatagatttaaatatattatgagggacagcgaaaattatacagtccatattttttatatcattaatatcattaagtttaattctgtattcatcccataaatcatctgcatttgcaataggatctactacctttatgttggtttcatactcttgaagctctctaattgtattcacaactaagctatttcttatatccggacagttctccttaaatgtcacaccaaatactgcaattcttgctcccttaatattcttcccggcttttaataacatctttatagtattttccgcaacatactttcccatactgtcatttattttacgtccagcaagaattatttgtgaatgatatcctatctcttcagccttatatgtaaggtaatacggatctattcctatacaatgtccgccaactaagccgggtgaaaagtccataaaattccatttagtttttgcagcttctaaaacagactttgtatctatccccattttattgaaaataattgaaagctcattcataaaggcaatatttatatctctttgagaattctcaattactttagctgattccgccactttaatactttttgctctataaactcctgcctttacaattgttttataaacttgtgatataatattaagtgactccctgtccattccagctactacttttgtgacattttccaaattgtggtgatcgtcccctgggtttattctttctggtgaatatccaattttaaaatcaatcccacatttaagacctgactctttctctaatattggtgcacatatttcttctgtaacgccaggataaacggtagattcatagactacaatcgaatctttttttaagtttctacctacaatagaacttgcctctttaagtggagataaatcaggggttttatttaaattaataggagtaggtacagcaataatatgaaatctagaatccaaaagctctttttcattatacgtaaacaagatatctgaattttttattttttccctttctacttcataagtatattttttacctttcaaataattttttattttatcctcagaaatatcaaaacctattactttaaaatattttcctaatgaaattgcaagtggcaatccaacatatcctaaaccaataactgatactttaaacttcttatcccgtaaagatttatacaagttcataatttcctcccataaatatatgcggacatgagaattcttgataaattacaaaggattcctaaaaaacagttatcaagataagtcaagtatacttaatacacacaatataaaaactctgaaaatttcaattcgcaattcgatttttcaattgccctttttaagttttagccctagcatatcaacatcagttgtatataaatacccttaacttgataccttcagcttctttgattattataccatagttaccacaattatacaaacatttttctggtttttcagaaaattctttttgattttaacaaattcaatggcttaaattccatagatagctagaaaggaataatactaaactttcgtcctgaactgccgatattaacaataaggccggcgcgatactccctataacatccttttcagtagatttcattatcgtgccggttttctcacatgcaaagcaatcccgccaatcagattggcgggattttattttttattaatttcctgtccaaacgtcttttatataacgtttttggtcttgcagcttttgcagccaatcggcggattcttcctgacttgcccctttttcagtttcatatgcccatcgcaaagttttctctacgtcaggagccatttgcgatccatcaccgcatacgtaaatatgagcgcctttttcaatgagtgtcatcaatttctgtgaatcttgcttgagcaagtgctggacatatccttttgattcgttttcgacgcgcgagtagcatcggcggattgtgaccaaaccttcctgttccgcttgatccagctcttctctgtaaaggtcgtcatggtccgggcggcggcagccgaagtataaaagtgcttcaccaagggtgcttccttccttcttcaaaaccgatcttgcctgaataaagcccctgaatggcgcaattcctgtgcccggcccgaccataatcataggcgtttcaggatcattcggcatctggaatccggactgcggcgtacgaatgaaacaggctgctgcatcacctgtattcaattctgctaaataattagaggcgacaccccggtattcacctcggccgctccatgctgaggctttcacaactcctaccgtcatgctcacgatatttgcatgaactttcggtgagcttgaaatggaatagtatctcggttttagtgatggcaaaagtgctaaaaaccgttcaaacggcatttcgcaagcaggataatcctctaaaaaatcaagcatggtaagacgttttgcaagtacctgctctttgtaaatgccatcatctgaaacgagctgttccagctctttttgatgcggcggacagactgtataagaggccagctcccgaagctgaagccttgatgccggttcctgcagctctacataggacgacaataaatccgctactttgatcggccgatccatcggcagatgagacatatgagcgcttccgctaacttttatcacatgattggactgcaaaccgaatcggctgagaacccgctgaacaagctccctgctgttctttggcaggattccgatatgatcgccttctttatatgttttaccagccggaatttccaattcaatatggcgggttgaacgcgtgctggcagctgtctggagttctcgattctctaacacaatcccttcaaacgcgccatatgctttagcaaccggcgtttccgtcgcttcactgagaaaagtaatcgataatgaaggcctgtcttctttctgggctatttcgttaatatcaaatgcgtccatcgtttccttccagaagcggttttcccaagactcgcgatggctttcaaaatcatcggcggcgtcaccttccccaatcgctgttaaacgcgatgcccctttgctttcatcatgtcatcaatcaggcggggaatccgctgatacgtgctggcccagctccggttcccgcagccgaataccgcataggaaacacctttcaattggccttcctcaagttctttcagccactctacaaagccggcagcattatcaggcggcgccccattataagaagccgttacaatgacgactgccccttcttcagggagcttgccgatataatcatcaagcggagccgtttcagctgtaaagcccatctggcggccttgagcagccaattcaccggctattccctcagctgtcccaagatttgaaccgtaaagaacaagtaaaggtgtgccgtgtttaggtttggtttcttttggctttgtttctgatttgatgtctgcctgttcttttctctgtacattgattgccgctgtttttcgcggtttcacagtaattttaaaatcatccggcttgatcgttaatgcttctttgatttttagttcgtagccagtatggtttatcaattcaaaatgctttaatacaagaccgagaaccattgtcgcttcttgaagagcaaactgcatgccaatacaagcgcgctgtccgtttccaaacggcttatacgcatggtgagggatacttgaaggatcctcaaaccgttccggacggaaatcttccgcatccggtccccaagcgttttgatcccggtgcagttttggaattaaaacagtgactggctgccctttactgatcggatattccccgcctagaacagtatcctccttcgcatatagagaaaaagccggagctgttggatacagtctgagggtttcatttaaaaccatccgaatgtatttgagctgctggatttgtttatattcaggcgtgtcatccgttaacacgcgatccgcttcctcctgagcttttttcagtttttccggatgtgtaagcagacaataaatcgcaaaggatagcaacccgcttgttgtctcatgtccagcaattaaaaatgtgatgatttgataccttatgttttcatcatccagcgtttcaccggttactggatctttggcataaagcatgagagacaagagatccttgatgttttcatccggattcgcctttcgctccgctatcattctatcaaccagggagttcatgacttctatatccttttggaactgcagcttcgttttcaccatcattttatcttgcaggcccagtcttttcgattgattcatcgcctcttttaaggcacggagcatactggtgataaacggatgctgtgaatcacggtaaaagctgttgaatcgatagttaaacccgcataacccaatcgtatcaagcgtcagacgtgtcatatcgtccgctacatcaatttcttcattagggtttaaccggctccacttttgaatcagctgagttgcgatatccagcatcatagaatgatagcctttcatcgctttttgactaaaactcggcagcaaaatgcggtgggctttttgccagttcggttcgtgcgtccagcttgtaaataagccatctcccccgaactcacgcaccttttgcaagcctttgccaaggttcttgtcgaagcgtttttcatcacacacttcagccacaaaattgtggcccgagacaaaaacactggatactcccggaaaatcaaaacggaaaatcggtcccaattcatcagctatccgccataaggattgagaaagctgttctttttccagatgcggaagattttttaaaggtccgtatgttttgggctgaggtattgcgcttgcctgtttcattaacatctccctttccttatttttgtgatgaatgaagcttaatggcgtcccagcagcattgttccaattcagtaattaaatcagtgtccatctctatatcacctgtttgaacgagctgatatatcttgagaaacgcccctaatacaatcgcaattaacacattagagggcaggctgcgaatcacgccttccgcttttcccttattaaaatagtcatcaagcatttgagtcagattttctatcatttttttgcttgtatgatttaagtaatgagcatcttttttggtttcaagaaaaaaaagcgcatagtcgctctctttcgtaaactgaacgagacagcaaaatacgtggtgaaagccttctctgacaggcaattctgaaacgtcttgcttcagtttttccgtaaatcgctggatgctttcttgaaacagtacgttgacgagtgtttctttgctgtcaaaataacgatagatcgttcctgtccctacatgagcacgttcagctatcataggaatagtggtagcgtcaaaacccctttccgtaaaaagtgagaccgacgctttcataatcatgtcgtatttactgctggatgcggataacatgtaatctacaacctccgattcgtttgcggaatgaatattcattcctattgttcataaagaatgtctgccctgtctgaaatcacctctttgttctttcttctgttataagtttatatgaaaaaaactttttttaatataaagtatatgcaaaaaataaaaaattaggaaaatatacccaaatcctgatgcgaggatcttggatatatttcccgagaaattttttatttaacagccacaatacatagacaggaatcacgcctgataacagaaagatccctgaaatgctggtctttcagcagttgaatatacgttttctctttttcaccggtatttgtgtcaatactgatataaaaccggccgtcaatttgaagcaccctgtaaatttctcttaatgcaagcctaatatcggtgcagctctgaaccgtatgtaaagaaaagactttattaaaggtacggtcatcaaagggaatgtcctctggatagccatgaaaaacctccccgttccccatgttctttcgattcgcacgtaatatctgtcttacctttcgctttgaaggatcaatgctttttaggcttcccttttctagtttcttggttatgcttttaaagacagtgccattcccaattccaatttctaaaattctgtcattttcttgtatatctatagagtcaatcatcatatgctcaattgttttggttagcttatatttccgagaaaataatttccaaaaatccgatcgtttatagagtctattttctagcattttaaacacctgcttttggtttcctatgtttatttattatattcaaaaaataaacatcatcttcattctaaaagtgaaggaaggtaccaactagacggcaatgtattgaaaaatgtttcaatagaactaaactttttcatttttttccgcaaaaaagcagaaaacaaaatgttttctgccctctttctaatgccaatgataagggaatgcaaacagcctttgctgctgcattgccatcagcctctgctgtcggaatggatttccataaccatgtttgaaggaatgcggcatggacgcataaccatggccaatcgacggaagccttttttgataatcgttcatcatgccatcacctgcctcacagtaacgttgatttattgtatgcaggcaggcatttccttgacagctgtttcgctaaacttggtccttctccattgtataatgcatcaataattccattctaagcatatgccattccccttcagtttttttcgttgcttttagcgccagtttgttaaataaagatgctttaactgagactctttcatttcatcataaatctgctcaatctgctgttctcgttcgaattcttccaggcttttaaaccttttttttatcgttaacgttaaaaagaataggttaatcgtcatatcgctcaccccctttcaaagtccgcatcaagcgaaataacccgcggcacaccccttctgccgcgggcaaataaaaaccgcagacaaaagaagacaccaatgcctctactgcctgcggggagttgcgtatgtccgactattccgaatttaatgcgtgcgataagcatcggttaaggaaggacacgaactcttccacaggctgaataaactatgaacttttacatgtgtatcacgtacaggttgacgtcgttgtctcattgtcattttggttcagcctcctttgcttttttcttactttgtaagtatatccaccaaattccattttgtaaacatctttttctaaaaatggacggaaattgtgcaaatcatcgaatggatttgcccgttggtcatgacacctgcttcatttcttttctggagcggtctttcttatgatatgcaataaaataaatgagaccgacaaatacagctccgccgatgacattaccgataaaagccggaatgatgtttccgatgaactgcccccacgtgaatgagcctgcaaaaatggcagcaggaatcacaaacatgttggcgacaacgtgctgaaatccgatagccacaaaagccatgattgggaaccagatgccaaggatttttcctgctgcgtcttgggcgccgaaagaaagccacactgcaagacatacaagccagttacagccgatgccggaaatgagaaccttgccaaagctcatatcaagctttccttgggcaacggcaatcgttttttctaaataaggacctgtttcagtcaatccaaccaaatgcccgaaaaagtacgcaacaaacaatgcgccgattaagttcataattgtgacgattccccagttaatcgccaactcttttactgatatttttctcgaaaataacgccatcgcaactgacatcatattgcctgtgatcagttcagcgccagcgagaacgacaaggatcagaccgactggaaatactgctgcaccaattaaactggacaggctcccccattctttcggaagatcgccgattaccctgatatcaagcaaatacccaagcgcgataaatgcaccgcctaaaaaccccagcacaagcagtgacggcagcgggagctttatttttttcatccctgcctcaattgctgcttccgctatttcatccggttttcgaaaagccataataaaacgcctccattacttcttcttttctcacagttatgcaagaaaggcaataaaaaaggcagcactcaaataacctgtgtcaaaccaggcgtttgaatgctgcctaacttgtatgcatacccatacaacaatatcaagcagtatgtaagatattgaaagagaatatatacagttcgtgcatacattccattgctttagccttctataactgtagcaacatcatatcaaatgtgacaaatttgtgtcaatgacaaatatactagctttgcagagcttctttttgctcatctatttttcggtcaaaaacaaatacagatacagcgatgttttcctcaattttaatatcagaaaacaaatggactagcttagctcccatgagttcctccattccttccggtgtttgtttggaataaaggtcttgaattaggcttgtccgggccgcatgtaccatctctcttccttcaggcgtgcgggcgataaactgctcgcttgcactcagatttccgtatagtgttgaaactgccatgttttctacaaatacagtatgaattctctcaggcccttttccgaacaattctttgcgaagttttcgaatgatatcattgaattcatgaatttttttagacatgctgattaccccttccgatattgccttataaaggcttttcccggttcccctcaggacatttcacttggttaaaattttcctgccatattgtattataataaatatcacattataataaaagcagtgttgatggatttgtaataggatcttgttatgagtctatcgttttataaaaatcaaggattggtctgttagtaagacttgctagtgaactattccgccatgtgtgtttacaccttcttagaattaagggcaggtgtatctatacatggctttttttgacttcttgaaagaaagatggaggggaatatgaatatgatggacgttaagtcgatcagtgtccgtgtagacggaacagaaattcaagcacgagcaggggccacaattttagatattttaaatgaaaacggaattgagtacccgcagatttgccacgtaccagaagttgacccgattcaaacttgtgatacttgcatagtagaggcaaacggcaagctggttcgttcatgcgcgacggttgcagaaaacgggatgtctattgatctatcaggaaatcgagtgaaagaagcgcaaaccgaagcgatggaccgccttcttgaaaatcatttgctgtattgtacagtttgcgataacaacaatggaaactgtacgctgcataatacagcggaaatgatggggatcgagcatcaaaaatacccatacacgccaaaagaagatccttcttgcgcggttgatatgtctcatcctttttaccgctatgatccaaaccaatgtattgcctgcggccagtgtgttgaggtctgtcaaaaccttcaggtaaatgaaacactctcaatcgactgggaacgcgaacgccctcgcgtcatttgggatgagggagttccgatcaatgaatcttcctgtgtcagctgcggtcagtgtgtaacagtatgtccatgtaatgcactgatggaaaaatcaatgctcgggcaggctggctttatgacaggcattaaagaggacgtcatggaaccgatgattgatctcgtgaaaaatgttgaaccggggtatggcagcatttttgccatttctgaagtcgaagcggcaatgcgtgaaacgagaacgaaaaaaacgaaaactgtatgtacgttctgcggtgtcgggtgttcatttgaagtatggacaaaaggacgggatattttaaagatccagcctgtttctgatgctccggttaacgcgatttccacatgtgtcaaagggaaattcggctgggattttgtcaattcaaaagagcggatcacaaagcctttaatccgtaaaaacggagcctttgtggaatcttcttgggaagaagccctcgatcttgtcgcaagcagattaggatcaattaaagagcagtacggtaaaggctctgtaggatttatttcttcttctaaaattacgaatgaagaaaactacgtcattcaaaaactagcgcgtcaggtatttgaaacaaacaacgtcgataactgctcacgctactgccagtctcctgctacagacggattgttccgcactgtcggcatgggcggtgacgccggcacgattaaagatattgccaaagcaggtctcgtcatcattgtcggtgccaatccggcggaaggacacccagtgctcgcaacacgcgtcaaacgggcacacaagctccacggtcaaaaactgattgttgccgacctgcgtaaaaatgagatggctgagcgatctgatctgttcatcagccctaaacaaggcacagaccaagtttggctgatggctgttacgaaatatatgatcgaccaaggctggcacgatcaggcgtttattgatgagaacgtcaattactttgaagattataaagaaacccttaaaacgtatacgcttgattatgcagaacgcatcactggcctttcaaaagaaaacatcattcaaattgctgaaatgatccgtgatgctgacggcacttgtgtcctttggggaatgggtgtcacacaaaatacaggcggttccgatacatcagcagccatttcaaacctgcttctcgctacgggcaactatcgccgtccaggtgccggcgcttatcctctgcgcggacacaataacgtgcaaggcgcatgtgatatgggaacattgcctggctggctgccgggatatcagcatattacagatgacaaagcccgcgctaaatttgaagaggcatatggtgtcgagattgatggaaagcctggtttagataatattcaaatgcttcatgccattgaagaaggaaaaatgaaagctatgtatcttgtcggtgaggatatggcactggtcgattcaaacgcgaaccatgtgcatgatattttatcaagccttgatttcttcgtggtacaggacatcttcctgtcaagaacagctcaatatgctgatgtcgtcttgccggccactccttcacttgaaaaagacggaacatttaccaacacagaacgccgtgtccagcgattgtatcaggcgcttccgacgcttggtgacgcaaaaccggactggtggattattcaagaggtggcaaaccgtttaggagcgaattggaattacagccatccaagtgacattttctctgaaatggcgagtctttctcctctgtttgccaaagcaagctatgaggtgcttgaaggctggaacagcttcctatggggcagcttcacaggtgaaagcacaccgcttctgtatgaagacggatttaatttccctgacaaaaaagcccgctttgccctttctgattggaccgagccagcggcatttccggaggaatatgaccttcatatcaataacggccggatgctggagcatttccacgaaggaaacatgacaaataaatcgaaaggcatccaagcgaaagtgccgaatgtattcgttgagatctcacctgagcttgcacaagagcgaggtgtttgtgacggttcgcttgtacggctcgtttctccgttcggagcagtcaaattgaacgcgctgatcacagaccgggtacggaaaaatgaactctatctgccaatgaactcgacagacaaggagtcagcgattaacttcttgacgggccctgcagctgataaacggacgaacacgcctgcttataaacagacaaaagtccgcatggaagtgcttggcggctgtgaaacagcgccgcttccaaaaacaaatccgcgcaacaaaaaacggcatccgcaaaacggagtcgaagcagaaagaaaatggaaccgtcctggctatgtccatctgactgattaaacgataggaggaaaacgaatggccactccgattacgacgatcaaaaaagaaacaaaaacagctgagcaaattaagcttgaaaaaatagaagaactgaaagagctgctggcggaaaatgaggacgccgtctctaaaacgatgacattaatgaatgaactcaatgatcttggaatttttgacgcggcaacaagcatgctcagagcgaaggaagacattgccaagattgcgcttggccaagtttcccgcgagcctgtcaccaacctcatcaacacgatgatggccgccggaggcgcattgacaaaagccgatcctgagtttacagcaaagcttttagaaagcgtaatggctgggactgaacaggcacaaagctttttaaaagaagacaagaaagtcgggattctcgacctgttaaaagcaatgaacgatcctgacatcaacagagccgtcggcttcggtcttcagtttttaaaaggcatgggaaaagaacttcgagaaaaataacaaaaaacagccatctcttgatgatggctgtttttttattcgtcggcttcttccaaacgcttcttgtaaataagtgaacggtcagcgcaaaagaaggcaccggctaaaaatacgcaatccgctaaaaacatagtcgatttctggcctaatgttaagccttgatcagggagaactgcgcctatatataaaaaagtgctgactgcaagcaatgtaaaagcaaaatgcttgtaatcttcttttaaagatttcattctatttttgttcaaaagaatcacctgccagattcatagtatacgactattataatataatccggcggcttacagagaaagtaattctatccatttgttatatattttcaagcgcttggccgatatcttccaacaagtcttccgcatcttcaattcctacagaaattctgatcaagccgtccgtaatgccgagctcaagccggcgtgctctcggaatagaggcatgtgtcattcttgcaggaacagaaattaagctttcaaccgcccccaggctttcagcaatggtaaacagtttcagttttcctaaaaacgcatcaacccgttcttcactgccaatatcaaaggagatcatgccgccgaagccagatccttgcgtttttgcaagctcatgtccgggatgatttgaagaaccagggtaatataacgtttggacagcagggtgattctcaagaaagcttgcgattttccgcgcattttgatcgatcgcttccattctgagtcccaacgttttgattcctctcattaacagccaggaatcttgagggccaagcacgccgcctgtggagttttgcacaaaatgcagctcttctccaagctctttcgaagctgtcacaactaaacctccgacgacatcactgtgtccgccaagatattttgtcgcactgtgaagtacgatatcagcgcctaaagtaagcggctgctgaaaataaggagtgttgaaggtgttgtctacgataagcagaacacccgcttcttttgcgatatcagccatgagcgtcaagtcggtgattttgagcaacgggtttgtcggtgtctcaatataaatggcttttgtattagggcgaatcgctttttcaacttcttccctgctgctcgtatcaacaaatgttgattcaatgccaagacggttaagcacctttgtcatcacgcggtatgttccgccgtacacatcatcagtcaacacgacatgatctccgctgttaaacagcatcataaccgctgtaatggcagccattcctgaactgaacgcataacctgcttccccgccttccagttctgtcgcaagtgcttcgagagcggttcgagtcggattggccgttcttgaatactcgtagcctgtatgctgccctgctttcggctgcttgtacgtgcttacttgataaatgggcacggaaactgcgcctgttttctcatcacctgtgattccgccatgtatcatcaatgtttttttcttcatatcagatgcctccttcgtatatttgtttgctgatatatcgatcgctgctgtcaggaaatactgtgacaatgttagttccagcagatgctttttttgcttcctccaatgccgcataaagcgctgcacctgaagagcttccaatcagcaggccttctttttctgccgcttctttcacaagtctaaacgcattctcatctgttacggtgtagatctcgtcaaaatggctcttatccatataatcggggataaactccatgccaatgccttctgttttatgagcgtgaggctctcctccgtttaaaatcgagccctccggttcaacaatcaccgttttgactgctggatttttttcttttaagaaggaagctgttcctgcgaacgtgccccctgatcctgcccctgcgacaaacgtatgaatattcccgtcaagcgcttcccacatttcaggtccaagcgtcttatagtaagtcgatggatttactcggtttttaaattgcaaaacgcaataagaattttcaatttcagactccagctgaatggctttttgaatggcgccctgcattccgtcttgacgcggtgtatgaatgattgatgcgccaagcgcttgcataatttgctgtttctctctgctgaagtgttcagggacacagaaaatcgctttcaacccatattttctggcacttagcgcaaggccgatccctgtattgcctgccgtagcttctataatcactccgccgggtttcaccttgcctgaatcgagcgcgtcacgaatcagcatatctcccagtctgtctttgatgctacccccggattcatcatttcaagcttggcatacaccgcgactccttctggaacatcaaagttcttcaagcggagaagcggtgtattcccaatcagctcggtaatgtccgtaatcactgtcatatatgtcctcctccttattagagggtgtttttagaaaaaacggaggagaacattctccccgttttaatgaattcgtttgatcacctttaacacaagctctgttgaatggacagccgcctgctctaaaaattggtcaaatgaaacatgtgattcttttcctgcgatatcagataacgctctgatgacgacaaacggcgttttaaattgatggcacacttgagccactgccgcagcctccatttcaaccgcgtacagatcagaaaatctcgcacgcacctcttcaacccgcttcggatcgttcatgaaagaatcgcctgttgcaatcgttccttttgcaacctgaatgccgtcgagttcagataccgcttcttcagtgatgctgatcagcttttcatccgccgcataagcagccggaagacccggcacttggccgtattcatagtcaaaagccgttacgtctacatcatggtggcgaacgtcagtggaaatgacgacatcccctacattcaatgtatgatgaaatccgccggctgagcctgtgttaatgacataatcaggcttgtaacggtcaagcagaagcgtcgtgctgatagcagcatttacttttccaattcctgattttaatagaatcacttcagttccttcaaattcgcctgttgtaaattcacagtgtgcgatcgtttctgtttttgcattttcaagtttgtttcttaagatggtaacttcctcttccattgctccgatgactgctagtctcatctattcacattcccttcactttaccgtttgatcgcctccattatccacacgaagtcgttttgctgagtgaatcggactgcaaaaccttcagctgtaaacatttctttcaacgcatccaatgtaggataatgctctgtctctaaatcatttgcaagctgataaaagccttgagaacgggctttatcgatagccttttgatacgcttgcgcatcttcaaagacggtatcggcaaacactattttatcatgcaagtgaaggtatttgccatattgctttatggcagcccgcttttcttcgtcagtcaaatgatgaaaagcatatgaactgacaattgtatcagcctgaaatggcggctcagggaatgtcaggaagtctccatcaacgatttccgacctgcctgaaagcttgtcagaagccagtttacgcattgctggagaaggttcgatcccaaatacagttttgcctgcatcgagcagcttagccgtcaaattccctgtcccagggccaaattctaacacatgcgttccagatttgctgacgatggcatcaaggatatgatcataacctctgaacgcttctttatactgaatatctaaaccttgtactgtttggtcataagttgctgcccaatcttcaaagagagggataaattcacgtcccatatttgtcacactccatatttaataattcctataagcatactatgaattaatgatggaacagttcctataataccacatcttctgaaaagcaggtactaaaacactttgtgtattttatgccatctcatattgcgcattgaccgcaaaaaagcttatacttcatatgacttgtgaaagctggagggtcaagacatgaattttcaattagatctgattaaagacaaagtggaattttttgaagcggcttcattgcaggagcttgaaaagaaaatcaatacacaaattgaaaacaataaagccatcatgctccgggtgaaatctgtttcacaccaaactgctgtggcagaaggaagaatattgtacagcgcggtggttcatttcgcagctgaagcctaaaacaaaagcagccggttgtaacccggctgcttttgtttattttagcttttctacttttgtcggcttccagcctttttcatcgacccatgtaatcgtcacttgatatttattcccagtcgccttgtccaaaatcttgcctttagcatcctgagggctgccgttatttccaagccagagcaccgtcatgttatctgttgagacaccagttgcgtatgaaatggctttcagcatctcagcccagtcttgtgagcttgaatcataagtagcggcatgctcgccagtctgctcagttccgactgctttccagtcaggattttcatacgttttttccacatcgctcgatgagccgccttctgttacttttgcatctttaagcccgtcaccggctgaatctgagcttgaatctgaatcagagtcatcttttttagaagaagaatcatcttttttggaatcagagtcagaagacttctcagaatccttttcgctgtcagatgtatctttcttgctgtcttttatatcctcatccgatttcttttccgtctttcctgaagccggagattcctgtttttgcgccgtttcagaatccttgctgacatctttgctagaaggactgttaatgaagagattcgctgctactacgacaattagtatggatacgattgcgattaaaatgttaagcactaaattggcttttctgcgtttatcacgattttcataacgagattgattattgctcaataattctgcactcctttatccctcttggctcagcatatattttaacatgtgctgagaagttgttctatttctgattgatttcaatttcgtgtacttttttaacaatatcataaaacaccgaatttgtcagagccttatctcccggtgtatccatgtgtaaaacaaccagagcgtatttcggcttatccgcgggaaaatatccggcaaaccatttttcatagagcgtttccttctcttttgaaagcttgcctgtttgggctgtgcccgacttccctgctacagtatacggaagatcttgaaaccttctgcccgttccggaaggagattctaccacccgccgcagtattttttgaagctgctgtgacgtatatttgtctatcgtttcccctttgagcttctgatctttaaacgtaacgagcgttgtgccgttcttatactcaatttgttcggcaattttcacctgccgtttttctccgccgcgggcgattgtcgccatcatattggctacctccagcggcgttacctttacatttttctgcccgattgctgtttgcgcaatggcttttttgactgatttgtctttttcatccccccaaatcacgccgcttttttcgttatacagctggcggaaatcggtttcgtggtacagttttccctcccagcctgcccgatcagtgagagccagcttctcggacatatcttcaataaccgagctgtcttttttcattaattgttctgcaagactcgtaaatgtgtaattacagctttgggcaaaactttcatcaaaagacaaggtgcctttgtcgtcccccggttccccgtacaggtttaaattgcaattaaaggtttgactaggcttcaccatattattttcgattgcagctgcggcaatgactgttttaaaaactgatccgggatagattggcgtcagcatataattttgaagtgtgttttgccgggacacatccgcatctggtttgcttacaattcccagaacactgctattttcgatgtccagcagcgcagctcctccctttttcagcccctgttcatccaatacctcctccatcgctttttgaatgctttgatcgatcgttgttttgacctggagcggataaaatgtattggcttcagctgtatatttgacgtccatgccaaacaaagggtttccttttccgtccacatgatataaaagctttgtgtcttgttccggaagcaaaaactcgtcaaatgtccgttctaaaccggttgttccgatttctgttgtaatcggaaggctctccttgtcaggatatttcttgcgaagcagcgccggatcttggttcgtgctccctatcgtatgtgaagcaaggctgggcttgtcttcattctccatatatacgccgtaaatgccgggatatttcaaagaattgatttttgtgatagattgttttgaaagtgttttgattttcttttgctgcaaaatgaccggtttttttgccttacctagtgtctggcgcaaatcatcttcagacatgccgaggatgtccgcaacttttttgatcggccaatcctgcgtcagcagaaaagggaacaaaacaaccgcaggctcgctttgtcctgtcagcgcccgcccgtttcgatctaaaaaagagcctcttccatctgaaataagcacttcctccgtccgctgtttcacactttcttgaatcaaattaattttctttttagaaaatgattctgtgaaaaacagctggatttctgcaagcctcagcagaagcagaaaaaatacaatcaaaaaagcgatgactgccagcttcattcgtttcgatatcttcataaaaaaacacctcacccacattgtggacgaggtgtttcgctgctaaacagatattatgaaattttcacaattttcacgagcatttctccgcccggtgtttgtactgtgacttcttcatctacttttttgcccaagaggctttttgcgatcggtgaatcgtttgagattttcccttcaaacgggtcagcttccgcgcttccgacgatcgtatatgattcttcatcaccgtcaggcagttcgacgaaagtgacggttttacccaaaccgacaacgttagagccgccgtcatcttcaatgattttcgcattgcgaatcatattttcaagagtcgtcacgcggccctctacaaatgcctgctcttctttcgctgaatcgtattcagagttctcggaaaggtctccgaagcttctcgcaattttgattcgctctactacttcttttcgtttaaccgttttcaaatattctaattcttgttcaagtttttgttttccttctgcagtcataggaaaaactttctcttgtgccatgtcccttcactccttctggttgtccctcaacatcttcgattatgtatgagagcataaactaaaaaatacaagaatgagaacacagggcagtcctcgttcttctctcccatataggtactgtttatcttaaactgaatcgtgtcgttctgcaaatatttcgcgtttataaacagggaaagaagggaattcgcacattcccttcctgcctatacataatatggtcagagttatttatgtctatgctatggtattacaaaatcgcgttttgttcaagaatggtttgaatttttgtgaccatcagatcaattgcgacgtgattctgaccgccttccgggataataatatcagcgtatcgtttcgtcggctcgacgaattggttatgcatcggacggaccactgacacatattgttcaatgacagaatcaatagagcgtccgcgctcattaatatctctcataatccgcctgatgatacgcaagtcagcgtccgtatcaacataaagcttgatatccatcagatcacgaagccttttgtcttcaagaacaagaatgccttcaaggataataacatcctttggctctacgtgaaccgtttcttctgaacgtgtgtgaagcttatagtcataaatcggcttttcaatcgggcggtaattcaatagatcctgaatatgctcgattaaatagtcattatcaaacgcaagcggatgatcatagtttgtgttcagcctttcttcaaacggaagatggctttggtctttataataaaggtcctgctggatcattaaaattgagtgtcctttaaactgttcataaatggaccgtgtgacactcgtttttcctgaaccggaacctcctgcgattccaatgactactggattcttacccatgggctgttacttcccctttctcatcatgttgctcggataaatctttttgtctagtttgaatttgacaatttgcaggggatggcgggcagcatctagctcatttccgtcttcgtcccaaatggtttcaatcgtatgtgtaaagttttcgatttctggaccgaaaaattccacttcgtcgccttttttgaagaaattgcgctgctgaagcgtgaccatttgtgtatcttcatcataattcagcactaagccgacaaaatcatatgtcgttttcttggcgtgttcgccgaacatttgctcttcatagcctggcgttccttcaaagaaagctgtcgcagtgtccctgttggcgcacttatcaagctcttcaagccattctttttgaatcacaaagttctctggatcagcgcaataagcatcgattactttgcggtatacgctgacaacagttgctacatagtgaatggatttcatgcggccttcaatctttaagctgtcgatccccatttcaatcattttcggaatggattcaatcagcttcaaatctttcgggctcatcgcaaatggtgcatcttcttcaccatacaaagcaacggcgttggcaccgtctgtttggtagagatcataatcccagcggcatgactggcagcagcctccgcgattggaatcccgcgctgtcatgtgattgctcagcacgcagcggccggaatatgcgatacacattgcgccatgaataaaggattcgatttcgatatctaccttttctttcatttctctgatttcaagagcgcttgtttcacgtgccagcacgacgcggtcgagaccttcttccttccagaactggacagccttccagtttgaaagagactgctgtgtgctcaagtgaacctcaacattcggcgccactctgcggcatgtttcgataataagcggatctgccacaataataccggcaacgttggcgtctccaagcgcttttaaatagtcttcaagcccgtccatgttttcattatgagcgaaaatattcgttgttacgtagatcttcgcgccatatttctttgcgaattcaacgccttctgcaatttcttcgatcgtaaagttatcggcattcgagcgaagcccgtattcctgtccccgataaagaccgcgtccgctccgtaatgaacagcgattttcagcttttcaagattacccgcaggtgcgagaagctccggctttttcgtaatcacacgctttccattaacgattgtggatattttatcatttacggcagtcatagcttaacctccttttgattaataaaccgtttccttgaagaagaatccggtatcaatttttctgtttactggctggatgctttcaatgcgttcgatccagtcttcttttttcgcttcgtattcgtcacggttttccacgcacaaatcaattgcttctctgtacattttggtgacttctattaggtattcaggcgttttcaaaacaccatcgattttgaaagaatcaattccggcatctatcaattcctcgagctcatcaatgatgcacacatcgttcgggctcatgatgtgagtgccgttttcatcttcgaaaatcggatatttattatcacgttctttatcgtgtaaaaacatgcctgattcttttttctttctttcaatgtccatgactttgccctgatattcaaaatagtttccaatcaaagaacgcttcgattggaacatgcacgtcattccatgcacctggatttcaatttcgacttccgcattttctttaatctcaacaatgctgtccatgtttaattctctggcaagcacagaacgcgccgcacccttgcgtccccagtagttgcatgtataatagttggtgcctgtcgtttctgtgctccaatgaagcttcagagcaggcgcagattcacgggcagccatcagcacggcaggatcgccgaataccgctgcatcgacaccggcttctgctaagaaagccagatattcgccaagctcacccactttatcgttatggaaaattgcatttacagcaacgtatacttttgctccttctttgtgagcaatctctacggcttttgttacatcttcacgagaaaattctccggctaatctcaagccgtatctctgttccccaactaaaaacgcagttgcccccgcctgtatgagcggcaaaatgtccgctgtgctcgtcggcgtcactaagagctctggttttttcatgacgttcacctcttctttttactaatcgcaagtccgtccccgacaggaataatcgcagtttgataatccggatgattcatcagccaatgattatattcatcaatttttgttacaagcctgcgccttctcttcggttctattttgctgtaatcctctgccaccagacccttaaacagcacgttgtccgttaaaatcaccccgtccggtgaaagcatcggttcatataaatgaaaaaagttttgatactgaccttttgcagcgtcaataaaaatgacatcgtaaggcgcggttacatgaacggcgtcggctaattcaagcgcatctccgtaaaaaacatgaatccggtcatcaagctgaaattccttgatattgtttaccgcttcttcatgccgtttctcattgcgttcaattgtatatatttcagcagacggcagctccagcgccattcgaatggctgaataaccaatggccgttccgatttctagtatttttttcggctgtttcacagacaaaatttgaagcagcacctccatgcccgctttttccatgatcgggacatgatgttcttctgcatatgcttcaagcttcttcacgttatccggccgaggctttaataatgcttctatatagtcatttatttgttcataccggtcagtcactacaaacagcctcccgttctaaaaaggagtgccccagtcttatgcacaggacactctctgaatacatcatgatacatcggtaaacaacccgatatattttatcataaaaccttgcggaaagcgaacaaaaggagagctttttgctctccttttatttctcattttttgaggaaatgtatttttcttttgctttattatgctcttttagcgtttttgtaaatacgacctcaccatttgatttggccaagaaatacagatagtccgttttatccggatgcagcgccgcttcccatgacgacatgccggcattggcaatcggccctggcgtcagccctgtgtttttatacgtattgtatggtgaatcgatttccagatccttataaagaacccgatctttatgcttgcctgccgcgtacaacacggtcggatctgtttggagcggcattttctttttcaggcggttataaaagacgctcgcaattttgtggcggtcggctttttcagtcgcttcttcttctatcaaagaagccatcgtcagcagcttatgcacagaaagtttgtttttcttcatttctgatttatatgtttccacataagaatttgtctgcttaatcattgccttgataatgtcttcaagtgatgtgtccggatcgttaaaagggtatgtagccgggaataggtacccttcaagcgggtgcttaatgtttttattgaaaacatcatttgtcacagtgtccgggaattctttcttcagctgattgataaatgtttcatcgtccagcttcgctatgacttgttttttagagtattttgtttcatcagcaatagcagccgcgatttgggtcagctgtgctccctcagtcactgtgatttgaaaagcgtaacctgtagccccgcttgtcagcttctgaataatggcatctaaatccatacctttattcagatggtagaatccggcctgaaacccggaagcacctttatatttcacatagtactgaaacgccttctcgctttttatgacatcatttttctttaatatcgatgcgatggctgaaacagacgaaccgctcggaatgttaatattaactgtcgttttactgtctttttcaacaggttcaagcaatgatttcccatataaaaatgccccgccaatgatgagaaacagcacaacaatggaagacagtatgattctttttttattaaaaaacgattttttttgctgattgatatacattaggtctcctcccatcagctcttatactacatgattcattgtatttcggcaatttattacaaaaagaggcctgcataaagcagaaaaaagccggagcagtatagctccggctttggtttggcgcgatgttttactcttcgtcttcgtccgctaagaatgtgtttagtgtttcttcgatcatatcccattcttcgtcagtttcaatcgggaatagctcaccgttttcaccgtcttcgtttggcgtgaagctggaagcaagaatttctacttcttcgtcatcttttgattcgattggatagtacaagacataagacttgccaaactcttcgttttcaaatgtaaacagcacttcacaaagctgttcatttccttgatcgtcaacaattgtaatatttttttcgccgtgttccattttcttcacctctggctttaatttaagctgtcaagatatccttgtaaaatcataacagccgccattttatcaatgactttttttcgtttttgcctgctgacgtcagctgcaatcagcattttttcagccgccattgtggtaagacgctcgtcccacagcacaacaggaacattgtacgttgtttcaagcactttcgcaaatgtttggctggcttcgcctctcgggccgactgttccgttcatgttcttaggaaagccgagcacgattttatctatagtatagtcctttatcagttcagataaacgggataaaccataatcgccttctgcttcatttatctttatggtctcaatgccttgagcagtccagcccatttcatcgctcagagctacaccgagtgttttggttcctaaatcgagtcctaatattctcattctttatttacgcctctttatgctgttctaaataagactttaccaattcctcgattaattcgtctctttcaagtttgcgaattaaattgcgagcgtcacgatgcctaggaatataagcgggatcacctgacagcaagtatccgacaatctggttgattggattgtagcccttttcctgaagcgcgtcatacactgtaatcagcacctcatttacgttagtctcagcagaatcatcggagaaattaaatttcatcgttttatcaaacgagctcaccgttttgcacctctttcccaaattcgcaggcaaagttcagcctggggtcctaatcttaccatcattctacactacatgggcgaattataaaacggatttcacccaatcttctacagaagccaaagcttcttctaatttttccggctgtttaccgcctgcctgcgccatgtccggacggcctccgccgcctccgccgcaaacttccgcagcttgtttaaccagcttgccggcgtgaaggcctttctcaatgaggtcctttgtgactccggcagagatattaactttatcgttttgtaccgcaccaagcacgatcaccgcagagccaagctttgctttgagttcatcgaccatagtgcggagatgattcatgtcttttgcatttacttttgccgcaagcacgtttacgccgtcaacttcttttactttcgacaggattgctcctgcttccacgttgcctagttttgcaagaagagattcattttctctttgtgcttccttcagttcagcctgcagagccgcgacccgtttcggcacttctttgatatttgttttcagctcgtcagcggtctgcttcaatacagaaatctggctgttcatttcgacgtaagcgccttgtcccgttacagcttcaatccgtcttgtgcctgcgccgattccagattcagaaacgattttaaacaagccgatttctgctgtatttctgacatggcagccgccgcacagctctaagctgtaatctccaacttgaacgacacggacaatatcgccatatttttcgccgaacagtgccatcgcacccatttcttttgcttcagcgatcggtttcaaatcaatgctgaccgggatgctcgcccagatcttttcgtttacgattctttcaatttgttcaagctcttcttttgtcacttggccaaagtgcgagaagtcaaaacgaagacggttttccgttacaagagagcccgcctgattgacatgagttccaagaacatcttttagagcctgatgcaataaatgcgttgccgtgtggtttttaatgacgccgcttctcatatggtcttcaacttcagccgtaacatgcaggcctttttgaacagtaccgctctccacaacaccttcatgcacatgctggccgttcggcgctttttgaacatctttaattcttacaactgcctgctcgcttcggagatagcctttatcgccgatttggccgccgctttctgcatagaacggtgtttcatcaagaatgatttgaacgctttctccttcatgagcctcttcgattaattggccgtcctgaagaagcacaatgatattggcatcagctttggtttgagagtagccgacaaatgtgctttcaactgtcacgtcgcgcagtgcgccgccctgcacctgcatgctgccgacatcctggcgggcgtttcttgcccgttcacgctgctggttcatttcctcctcaaagccctcatggtcaaccgtcatgttctcgtcttctgcgtattcttcagtcaattcaaccgggaatccatacgtatcatacagtttaaacacatcagcacctgagataacgctgctgcccttgtctttttcttttttgatcatttctgacaggatcgcaagcccttcattaagggtctcatggaagcgttcttcctcggttttaatgacttttgcgatgaaatccgctttctctttcacttcaggatagaaatcagccatgatttctgcgacaaccggcactaaatcaaacatgaacggacgatggatgttgatcgttttggcataacgcacggcacggcgtaataagcgtcttaatacatagccgcggccttcatttgacggcagcgcaccgtcactgacagcaaaggcaaccgttctgatatggtcagcaatcactttaaacgcagtgtctttcacattgtctttgccatatgtttcaccagaaatcgattctgttgctttaatgatcggaacaaacaaatcggtgtcaaagtttgtcggaacattctggatgacagataccattctttcaagacccatgcctgtatcaatgtttttctttggaagcggtgtgtacgtgccgtcagggttatggttgaactctgagaacactaggttccatacttccaggtaacggtcgttttccccgcctgggtaaagctccggatcttccggatcattaccgtatgcttcaccgcggtcgtaaaagatttccgtattcggtccgctcggcccttcaccgatatcccagaagttcccttccagacggataattctttcttcaggaataccgatttttttcgcccaaaactcatatgcctcttcatcttcaggatgaaccgtaacagagagaagctctttgtcgaagccaatccacttgtcgctcgttaaaaactcccaagcccatgtaatggcttcttctttgaaataatcgccgatggaaaagtttccgagcatttcaaagaaagtgtgatggcgcgcagttttacctacattttctatatcgtttgttctgatcgctttttgagcgtttacgattcttggattttccggcacgacacggccgtcaaaatattttttcagcgtcgcaacaccgctgttgatccaaagcagtgaaggatcctcatgaggcactaatgacgcgcttggctctaccgcatgtcctttttctttaaagaaatccaaaaacatttgacgcacttccgcagaagttaagtgtttcattgtatttcctcctctataaaaatcgaaattctcttcagtgacagcaaaaaagccctccccctatgcaaaccaacgtttacacagggacgagagctgtctcgcggtaccaccctgattacgggcattcattcgcccgtcacctttaaccctgtaacgcaggataagcggcagtgattaactgcactcaggattagcttcctccgatcttctgataaagctcctttcagcttatggagcttctctctttaacagggcttcggcgtactcagatccgtcactcgagattcgtatgtattctacgagaaattatagacaagcggcacgccgatgtcaatgctccgtcctcatccgcaaaaaatggatcatcattacttttaaaacagccgtcgcaggaacagccagaatcatcccgacaattcccgcaagctcccctccggcaagaagcgcaagcatgataacgaccggatgcattttaaggcttctgccgacaatgaacggactgaggatatttccttccataaactgcagaataaacaccgtaatcaccacaacaagaacagccttgactgagatcgtcatcgcaattagcaacgcaggaacagctccgatgaaagggccaaaatacgggatgacatttgttactccagagataaggccaagtatcagcggatatggaagcccaaatacccaaaacgaaatgcctgcaatcacgccaagaatcaagcagaccaaaagctggccgcggatataatcgccaagcgaatcatccacatcccgcaaaaaggcgctgccccgctttctccacgacttcggagtcaagtaccatactgtctttttcattaattcaatgtccttcaccatataaaacacgagaaaagggattgttgcagcaattaagaagtaatcaagcacattgcggatcccgctgatcgcaccctcgatcgttcccgcaaaaaacgcctccgtctggcggatcattttatctatacggtgatgcataccatcaggccagtcatccgtatggttatgcacatgaagaagaagcccattatacgtttcagcaaacatgggtatattttctgacaaatccgtcagctgcacgattaaaacaggcacccctttatacaacgcccagccaatcccgccaaaaaaaagaacataaatgaccaagatgctcaaagtcctaggcaatcctttgccatgcagccattccgtgaccggaagcaataaataagatataaaaatagaaatgatcaagggaataaagatcgtttttatgacgagccaaaagggtgaccataacatatcaagcataaaaaagacatagactgttaacagaaccagcaaacaaatagccacccacaacaaaagctgcaccggtttttggagcatctgctttcacctcacctatatcttttgaggtttacacggaattattctattatgtttctttagtcagccagaagtcatggacattttttcacatttaattttcagaaaagtttgatcatttactttttggtcaaattttctgataggaggattgcgatgatcacatttcaaaatgtaaacaagcattacggagattttcacgtgttaaaacaaattaatcttcaaatcgaaaaaggtgaagtcgttgttatcatcggcccatccggttccggtaaaagcacattgctcagatgcatcaacagacttgagacgatcaatgagggagtgctcacagtaaacggcaccgtcattaacgacagaaaaactgatatcaatcaagtgcggcggaatatcgggatggtgtttcagcactttcatttatatccgcataaaacagtgctgcagaacatcatgctggctccggtaaaagtgcttagacaatcacctgaacaagcaaaggaaacggcgcggtactatcttgaaaaagtcggcatcccagacaaggctgacgcctatccttcccagctttccggcgggcagcagcagcgtgttgccatcgcaagaggactggcgatgaagccggaggtcatgctgtttgacgagccgacatcagcacttgatcctgaaatgatcggcgaggtgttagatgtcatgaaaacactcgccaaagaaggcatgacaatggttgtcgtgacacacgaaatggggtttgccaaagaagttgccgaccgaattgtcttcattgacggaggaaaaattttagaagaagcagtgccggctgagttttacgcgaacccgaaggaagaacgggcccgcttattcttaagccgtattttaaatcattaaaacagaaatgggggagcttgtatgaaaaagattttttctttagcattgatttctttattcgctgtcatcttgcttgccgcttgcggcagcaagggatcaaacggagaagcctcaaaggagagcaaaaaagatacgctagccgctattaaagacaatgacaaaattgtcttcggcgtaaaaacggacactcgactgttcggtcttaaaaatccaagctcaggtgagattgagggttttgatattgatattgccaaacaaatcgctaaagacattttaggtgatgagaaaaaagctgaatttaaagaggtcacctcaaaaacaaggattcctatgctgcaaaacggggatatcgacgccattgtcgccacaatgacgatcactgaagaacgaaaaaaggaagttgatttttctgatgtctatttcgaggccgggcaatcgctgctcgtgaaaaaaggcagcaaaatcaagagtgtcgagaatcttggcaaaggctcaaaagttcttgcagtaaaaggctccacctcctctcaaaacattcgtgaaaaggcgcctgaagcatctgttttagaatttgaaaactacgcagaagcctttacagcccttaaatcggggcaaggcgatgccctcaccacagataatgccattttatatggaatggctgatgaaaataaaaattatcaattaacaggaaagccttttacagatgagccttacgggatcgccgtgaaaaaagggcaatctgctctcgcgaaggaaatcaacgcttcacttaaaaagatgaagtcggatggcagatacgatgaaatttataaaaaatggatcaaagaagacccagctgaataacaaccatcccgggatgagcaggtgatgctcatcccgatttgataaggagtgaataggcaaatgaatgtatcaattcttttcgataacttcggcatgtatatggacggtttttaccataccttgctcgcaagtgttatcgcgctggccggcagttttgtcctcggcgttgctgtagcggttatgagaataacagtctttaagccgctgcaatggctcgggaccgcatatgtagagttcatccgcaacatccctcttcttttaattacctttgttttctatttcggacttccaaacgcaggcctgaggcttgacggttttcaagcgggaacggttgctctcaccatttatacctctgcgtttatcgctgaagccatcagagcaggcatccagtctgtttcaaaagggcagatggaagcggcacgctcgtcaggctttacctacagccaagccatgctccatatcattttgccgcaggcaatcaaaatcgtcatgccgcctttaggcaatcaatttttaaacttagtcaaaaactcttcgattcttggggttgtggccggattggatcttatgtaccaggctgatttagtctcgtcgagcacactcgttgtatttgatgtttatattttcgtggcgcttttttacttagtgctgacgattccgcttagcatcggtgttaactatctggaaaaacggctggaaaaaagctattgataaggagtgagttacattggatttcatcggtgcttattcacaggagcatttagcgtttttatgggatggctttctcgtcaccttgtacgttgctttcatctccatcattctgagctttttcttcggtttaatcgcaggaaccctgcgttatgcgaaagttcccgttctttctcaattgattgcggttctcgttgaaacgatcagaaacctccccttgctgttaattattttctttacgttttttgcccttccggaaattgggattaagcttgaaattacagctgctgcaattacagcactaacgatttttgaatccgctatgctatctgaaattatccgaagcggactgaaatcaattgacaaaggacaaattgaagcggcgcgctcctccgggctgagctatacacagaccctgttctttatcgtcatgccgcaagcgcttcgccgcatggttccgcccatcgtaagccagtttatttctttattaaaagatacatcgctcgctgttgtgatcgccctgcctgaactgattcacaacgcgcaaattataaacggccaaagcgcagacggcagttattttttcccgatctttttacttgcggcccttatgtatttcgcagtcaactacagcctttcactcgcagcaagacgcctcgaggtccggcaaacatagaaaaggatactctttggagagtatcctttttgcattaaaacattttcgtaattcttcttctcatccgcttcatgcttcgattattcagcatgtcagattgagtcgccattcggtacacgagagctccggctcccattgccaaaagagaagtcatcgtccgattcatcctgcgcatctcctttcatgattaaaaattgatgctgcgttcatcctcagaaaacaaatcatccaagctgcttaacgttccgtcttcttccacctgatgagttgcaatcttccctttcgccactgtcagttcaataaaacagccccagcaataatattggttcacgccgattttgccgatatccttacttttgcaattcgggcatataagcatacctcacacctctatccgttcagaacgatctcgtctttccgcacctcgacaagcgaatccgctctttggatctggcgcttgcttcccgccaggtcagaaaagaaaccgtccgagagttcatatgctacgattatgcccctgtccaaacaaaagtatacatcttccagcatccccaatatatcgccctcttgcgatttcacaagcttcatcttcatctgctcgtatgtgaagcatgttttcggaagaggcagaagctgttctgaactgaccgaagccaatatgcggtcatcaagaatggaagagatatcacacgcccgtaatagcgcatgatgatgatgcaaaaagcgtttttgtgcaagaataaacccgagacaatctcccttcatagaaaaacaaatatcagaaattgccccgagataacaagaagttcgttctgagtatactgggaatccttctacttcatggcatgttctcaaagtgtgatcaaccaccttttgttgaacaggcttaggttttgctttgcgccttagactcatacgatgaaatcaattccactgcaaatgaaaaaaactcccgcttgcacgggagcattttattgctgttcttctttcataaaatcgaatggtgtaatgccttccatgccaatgttggcgtcgtgtacgctgaacgggagctctttttggagagcctcaagctcggcatccatttcctcaacctgtacggacagcctgttttttaaggaggtctgtctgacagttgcatcattatttttcacgccccactccagcgcctcctcctcaccgcataaaatgagaaatttcttcgctcttgtaatcgcggtataaagaaggtttcttctgagcattctatagtagcctttcacaacaggcaaaaccacaatcggaaattcacttccctgcgatttatgaatagaacagcaatacgcatgggtaaattgattaaaatcctttttcgtaaatgtcatttcattgccgtcaaaagaaacgacggccatgtcttctttttctgtattttcctttgcataaaatatcgacgtgatttcgccaatatctccgttgaacacattgttttccggctgattgacaagctgcaaaattttatctccggttctgtagacaacatccccgaacttcaattctctccgtttttctttaggaggatttaaaatgtcctgcagcatcacattcaattcattaatgccggcttttcctttgtacatcggagcgaggacctgaatgtcctttgctgtatagccttttttcaatgcattggcgacaaccttctcaactacttctttgatttgcgagcctccgcagcgaataaaggaacggtcctttgtcggggcagtcaaattgttcggcagcaatccatttttcatctggtgggcaagctcgacgattgatgacccctccgcctggcgatagatgtctgtcagtctcacagtcggaatcacctgggatgccagcaggtctctgagcacttgtcccggaccgacggaaggcagctggtcttcgtctccgacaatgatgatttgtatatgatcagggatcgccttgaacaaatgattcgccagccatatatcaagcatactggcttcatcgataattaacagcttcccttcgatcggctgatcctctgtatgagtaaagccttcagcgccgttccagccaagcagcctgtgtatcgtgactgcaggaagtcccgttgattcactcatccgttttgctgctctccctgtcggagcggccaaaacaatcggaaaagcttcatcctttttataagctgacgggtctagtgacacaccgtgaagctctccgtagagctcgacaatccctctgattaccgtcgttttccctgttcccggaccgcctgttaaaagaagcatcggcgaggaaagggctttttgaatcgcttccttctggctgggggcatactgaacgttcatccgttcttccagttctcccaacgcgagcaaaaactctgattcgggaaactggttctcatattcggtttggctagcgatatatttcacacgctttgcaacgttttgttctgcgtaaaacagcgatggaaaataacagcggccatcttcaatgacaatgtctttattttctccaagggcaataatcgcgttagcggcatccatttctgtgatgcgctgcccttcccttgctgactggtttaacagagattgggtgtcaatgatcagctgttctgtttctatgtacgtgtgcccctctgacagacaagtcgcttcaagcgtgtacaaaatagcagcttttacccgctcaggatggttacccgaaagacccattctgctgcccagctcatccgctttcccaaacccgatgccttctacatccttcacaagctgataaggattttcctgaatcttttcaagcgtctcggattcataggcttgatagattttcatagacagctgcgggccaaagccaaactgattcaaggaaatcatgatttgctccagtccctgatgccgctgcaatgcaccggccagcgtgtctgctttcttttttgagagtctgggaacatcataaagcactgaagcgtcagccaatattttattaatggcgctgtcgcccagctttttcacaatttcttcagctgtttttttgccgatcccctcgaataaatcactcgataaatattgaatgatgccttccttagtcgttggaatctcctttttgaaatgctccgcctgaaattggagcccgaattttggatgggttacgatctttccgtaaaacgtgtaggtctcttcttcttgaagcgcagggaagtagcccgtcacggatacggctttatcttcaatggcttcggaggtctctgtgactttcactttcagaaccgtatataaattggtgtcattatgatagatgactgtgttgactgtcccttttaaatagggctcttcctccagtttaagctgatccggatgctgctgcacgagctgtccctcctcctgtgcctgttatgatggatcaatcagttttttagcatgaagcgcaagcatatgatctggctggatatcaattgccttgtccagcatttccagcgctttttctcggttttctttataagcataagcgacaccggcattataaaatgcatctgcatgccccgggtcttgctctgttacagctgcgaattggctgagcgcttcgtccagcatgccctcgttggctaagcacatcccgaattgaaaacgcgcttccgtatcgttttcattcagttcgaccgctctttgtaaatatggcagtgcaagcttaggctgttcgagcttgacaagcaccgttccgagcatgtaaaacaggtcgccgttttccatccccgcacgaagcgctttttcaaacatgtctttggcttctttgtacatttcttttacaacatagacatttcctgctccataataagcagtggctgcgctattgtctaattcaagcgctttatcataaaacgcaagcgcacgttccagctcgtttacggatgaaagcaggttggcaaaattgatatacggaatcgcgtcttctttattttcttcaatcgcttttgtaaatgcctctgccgctttctcgtaatcgccttcctgcatcgcctctataccgagttgattataatccaccgatcatcttcctttcattaaaaaaccccaactcagtgttgaggtttttcatcttttatacgtaccacaattttgttccgtctttgtacacatcatcaattgtcccgccgccaagacattcttcgccgtcatagaagacaacggcttgtcccggcgttacagcgcggacttgttcatcaaagatgacttccgcttcaccctcgccagtcatgcgcaccgttactttatgatcttcttggcggtaacggaatttagccgtgcaggaaatctcttcgcccttcatgatatccgaacgtacccagctgatatttgttgctgtgattttgtcagaatataaaagcgggttatggaacccttgatccacgtagaggatgttcttttcaagatctttgcctaccgcaaaccacggctcgccgcttccgccgatgccaaggccgtgacgctgtccgatcgtgtaatacatcaacccgtcgtgacggccttttacttcaccgtccatcgtcatcatatcgcccggctgtgcagggagatattggctgagaaacgttttgaagttgcgttcgccgataaagcagatgcctgtactgtcttttttcgtcgccgttgcaagttctgcttctttggcgatttcacgcacacggcttttttgaagttcgccgatcgggaacatgactttgctcagcgtatcttctgtcagctgattcaagaagtacgtttgatccttgttttcatcaatgccgcgcagcattctgacttttccgccgcttctgtctactcttgcatagtggccagtcgctaaatagtcggcgccaagtgacaatgcatgctccaaaaaggccttgaatttaatttctttgttgcacagtacatccgggtttggtgttctgcctgctttatattcatcaagaaagtattgaaataccttctcataatattgcttttcaaagtttacggcataatacggaattccgatttggttgcagacgcggatcacatcttcataatcctctgtcgccgtgcaaaaaccgttttcgtccgtatcgtcccaatttttcataaagattccgattacatcatagccctgttcttttaacagcagggccgccacagatgagtctactccgccggacatgccgacgacgactcttgtatcctccggccgtttttccatttcattcactccaattactaagccgccttattgtgtcagccgtttgacaacgtcggccacatgtttggcagcagttttcacttgctcagccgtattgccgaggccgaagctgattcgaatagaggacgtcagccggtcactctcttctccgaacatagcagtcagaacatgtgacggcaggactgaaccggccgtgcacgctgaaccgctggagacagcgacacccgccatatcaagattaaccagcagcgcttccactgacacaccggggaaataaagattcagaacatgcggcagactatgctctttgtccccgttgatctcgaatgccacacctgcatctctaagcgtgtcggcaaagattgctttaaacgattgatacttctcgtttttttcgtcccgttcttcacttgacagcttgatcgcttctttcagcccgacaatgcctggaacattttccgttccggcacggcgttttctttcttgctctcctccgaataaaagcggtgaaagcttcacatctttactagcatataaaaagcctgtcccttttggcccgttgagcttgtgcccggaaacagacagaaggtcaatatggctgtttttcacatcaatgggcagcaacccgaatgcctgaacagcatcggtatgaaaataagctttgtgttcctttaacagctcaccgatttcttcgatcggctgcactgttccaacttcattatttccatacatcactgtcacaaggattgtatcatcacgcagtgcttctttcacctgttttgcactgactcttccattttggtcaacgtccagatacgttatgtcaaatccgtcttcctcaagtttttcacaagtgtgaagcacggcgtgatgctcaatttttgttgtgatgatatgtctgccaagatcttttcttgcaagtgcggttcccatgatcgccaagttatcagcttccgttcccccacttgtaaaaatgatctcctgctctgccgctccgatttctgctgcgatctgcgctcttgcttcatccacccattttcgagattctctgccaaatgaatgaatactggagggattaccgaaactgccggagaagtgcggtatcattttatccagcacgcgctcatccatcggagacgttgcggcatgatctaaataaatccgttccattatgtttacacctctgatctaaatatagaacatataagcttcttgctctccgtctgtatagctggcaagatcctctaatgttgtactgtctaaaacctcttttacagcatcccgaatgcgaatccagagctcacgcttggcaggctcctcatcttccagcacttcaacagggctgatcggcccctcaagcacacggataatatctcccgcggtaatggcatccggctcactgcctaatacatatccgccatatgcgcctctgatgcttttcactaaaccggcatttctgagcggcgataccagctgctccaaataatgctcggacaaattattcgtctgtgcgatgctttttaatgaagtcgggccttcaccgtgcttttttgcaagctcgatcataatggtgagcccgtatcttcccttagttgatattttcaacatgaacacctctgttatttcatgattttccacatttataatggtaatttctatatgtttcgtccgtttattatcttatagaccaactgttattataacataccttcagcgaattttcattgaggcagaaggaaagggggcctttccccttttctaatgtacggttttccgttaccctgtaattaagtaaggagagatgatagatgaagccattggcatatcggatgcgtccgacaaaaatagaggatattatcggccagcagcatctggtggctgaagataaaattattggcagaatggtccaggcaaaacatttgtcatccatgattttgtacgggccgcccggaattggaaaaacatcaatcgcaacagcaatcgccggttcaacaagtattgcttttcgaaagctgaatgctgtcattaacaataaaaaagatatggaaatcgtagctcaggaagccaagatgtccggccaagtgattttgattctggatgaagtccacaggctggataaaggaaaacaggattttctattaccctatttagaaaacgggatgatcattttgatcggagcaacaacggctaacccgtatcatgccattaatccggcgatcagaagccggacccagatttttgagcttgaaccgttaacacctgatctgattaaacaggcactggaacgcgcgctccatgatgagcatcggggccttggcacctattctgtatccattgatgatcaggcgatggagcattttgcccacggatgcggaggagatgtccgctccgctttaaatgcgcttgagcttgccgtgttgtcaacgaaggagtcaacagacggtgaaattcacattacattagaaaccgcggaagaatgcttgcagaaaaaaagcttttctcacgataaagatggtgacgcgcattatgatgtactgtccgcttttcaaaaatcgatccgcggctctgatgctaacgctgctcttcactatttggctagattaattgaagccggtgatctggagagcatcgcaagacgattgcttgttatcgcctatgaagatatcggtttagcaagcccgcaagccggccctagagtgctgaatgctattcagaccgctgagcgagtcgggtttcctgaagcgcgaatccctctggccaacgcagttattgagctttgcctctcaccgaaatcaaactcggccattctggcaatcgatgaggctctggcagatatcagagccggaaaaattggggatgtcccgaagcatttaaaagacgcgcattataaaggagctcaggaattaggaagaggaatcgactataaatacccgcacaattacgacaacggttgggtcgaacaacaatacctccctgatcctctgaaaaataagcaatactataagccgaaacagacaggaaaattcgaatccgccttaaagcaggtgtacgataaattaatgaaaagaaaataaaacaaaaacagccttgatcatcaaggctgtttttatgcattatttatccttcacacgtttgatttcaatgtctttcaaaagatccatgacaacatgtccgcccataatcaaacctgcgactgacggcacaaaagcattagaggaaggcggcatttttgctttacggattttcgcttcgtcatttcccacttcttttctgacatcttcccgaatgacaatcgggctttcatcagagaaaatcacttgaacgccttttttgatcccctctttgcgtaatttcgtacggacgaccttcgcaattggatcagtgtgcgtttttgagatatcagcgatttggaagcgtgtcggatccgttttatttgctgcacccatgctggagatgagcggaatatcccgtttcagacattctttcattaaatgaattttataacaaatggtgtctgacgcatcaatgacatagtcaagatcatagtcaaaaaactgctcatacgtttcctccgtatagaacatttttaacgcgatcacttcacactccgggttaatgtctgcgatccgcgccttcattaaatcaactttcggctgtccgacagttgaaagcagcgcgtgaagctgacggtttacatttgtaatgtcgacatcatctttgtcgacaagcagaatgcggccgacgcctgaccgcgcgagagcttccgccgcgaacgacccgactccccgactccaagcacagcaactgtgctgtttttcagcgtttcaaggccttcttttccgatagctaattcattgcgtgaaaactggtgtaacaagaacctcactccacattcgtattctggtttcatctataaaatggctgatccatgagcagccgtttttctgcgcacaaaaaataaagtcccaatagtgccgttgcagctttcctttgttttgaacccgctctcagcaggtgggtgccctcttttaaatcttgtaagtcctctttaccgaatgaaaagaggcatgtacgccatttaaaaatgcgggctcccaaatcaaaaaaatgttcggtcaaaactaggtgtacaactaacacatcaggactttatttaacttgtcaaaatcatatcacagacgattttgattttcaagaatcgaactgcccaatcagttcttaacttttttcttgatagaaagatgaagctcgtcaagctgggcatcgcttacttctcccggcgcctctgtcatcaggcagcttgcacttgctgttttcgggaatgcaatcgtatctctcaggttcgtacgtccagcgagaagcataacgagacggtctaagccgagtgcgattccgccgtgcggaggagcgccgtattcaaatgcttccagcaggaatccaaactgttcagccgcttcttctggtgagaagccgagaagcgcaaacattttttcctgaatatccttttcaaaaatacggattgaaccgccgccaagctcatagccgtttaaaacgaggtcataagcttgtgctttcatgtcttcaggcgctgtttcaatcagctcaaggtcttctcggacaggcattgtgaacggatggtgtgctgcgtaaaaacggccttcttccggatcatgctctaataacggccagtcgatgacccataagaaattaaacaatttttcgtcaatcagcccgcgctctttcccaagctttaagcgcagggcgccgagtgatgcggccacaacttcgaattgatccgctccgaacagcagcaaatcaccttcagcagcatcaagtgcttcaatcagcttagactgcttttcttcatcaaagaatttagcgatcgggcctttcactccgtctgcctcaaccttcacccaggcaagcccttttgccccgtagtttgcagcaaaagcgccaagagcgtcgatgtcttttctggagtaatcgccggcaccgccttttacgttgatggctttaaccacgccgccgtttgctacagctgatgagaacactttaaattccgtatcctttacaatgtcagacacatccgtcaaaagcatgtcaaaacgcgtatccggtttatcagaaccgtacttgttcattgcttcgtcatacgtcattcgaggaagaggaagcttaagttcctcaccttttgtttcacgcataacctttgccatcatctcctcagccaatgacataatgtcttcctggctcataaaggacatttcaatatcaatttgcgtaaactcaggctgacggtccgcacgcaagtcttcatcgcggaaacagcgggcaatttgataatatcgttcaatgcctgataccatcagaagctgtttaaatagctgcggggactgcggcagcgcgtagaactcaccttcgtgcacacggctcggcaccaagtagtcacgtgcgccttcaggcgtgcttcctgttaaaatcggcgtttcaatatcaagaaacccattttcatctaaaaagctgcgaacagctttcgtcacgttatggcgcagctgcatcgtctggaacatagccggtctgcgcaaatctaagtaacggtgttttaaacgaacgtcctctgacacttcttctgcttgatcagaaatcgcaaatggaggtgtctttgcagcatttaatacgttcactccatcagcatgtatttcgatcgcgcctgttttcaaattcggattaactgttccctcttcacgcgccaccacttttccttgaatatcaagcacgtattcatttctgatgccttccgcaatagcaagcgcttcttttgacacatcagggttaaaaacgacttgaacaatgcccgtacggtcacgcaagtcaataaaaatcaatccgccgaggtctcgtcttttttggacccagcctttcagcgttacagattcgccaattgctttttcagttatatcaccgcaataatatgttcttccaaacaatgcgtttcactccttatcccttttggtttgccttcatcacatgtataaattcatcaagtgccacttcaatctgttcgcccgtctgtgcatcctttacattgattttgttttgggcaagctcatcttcacccaaaatcgcaataaatctggcatttaagcgatcagctgttttaaactggcctttcattttcttattttcataatcgatttcactggaaatgcctgcttctctcagtttgtacaccaatgaaacagaataatcctttgctttttcgccgagtgtgacgatatagcagtcgattcccttatcaacaggcagctctcgtttttcagcatcaattgcggcaagcaagcgttcgatgctcatcgcaaatccgatgcccggtgcttcaggtccgccgatctgttcgacaagcccgtcgtagcgtccgccgccggcaagtgtcgtaatcgcgccaaagccctccgcattgctcataatttcaaatgcggtgtggttgtaataatccagccctctcacaaggttcggatcgatttcatacgaaatgcccagatcgtttaagtattgtttcactttttcaaaataagcggccgattcatcgtttaaatacgtcaaaattgaaggcgctgatttcatcagctcatgatctcggtcttttttgcagtccaagattctaagcggattcgtgtgcagtcgtgactggcagtctgaacaaaattcttcgatgcgaggctcgaagtgtttcacgagcgcttctctgtagcttttgcggctatcttgatcgccgagactgtttatgacaagcttaacgttttctaaacctgctttttcataaatactcatcgcaagcgccattacttcagcgtcgattgcagggtctttcgaaccaatcgcttcaattccaaactgataaaactggcggtaacggcctgtctgaggacgttcataacggaacatcggcccgacataataaagctttgtcggctgaaccggatttgcaaacagcttgttttcattaaaggcgcgaaccgccgcagctgttccctccggacgaagcgtcaggcttctgcctttgcggtcctcgaaggtatacatttctttttgtacgatatccgtcgattctccgacgcctctggcaaacagttctgtatgctcaaaaatcggtgtgcggatttctttatattgataagtgcggcaagtgtctctcataatttgttcaacatactgccagcgatctgattctccaggcagaatatcctgtgttcctctcggaatgttatatcccataggtagacctccttatgtattccttataaaatatccaacatgtgatcgttaatgatgaaaatgaaaaaaactctcgtccctactatacatgatagtagggacgagagttatacccgtggtgccaccctagttggaatacgttcatattcccgctcgatcctttaacgcaggttcacgttcactgcctaatggcgttattcacgcgttcagcaggaaacctccggagtgttgtttcgagaaagacgcaatgggatccgctttcagcctggggcgggttcctctctaatcatgcaatctgacctactcttctccattattggttcaaatctttcatcatttgctatgtactcaatttctattataataatgggattggggttctctgtcaagctttattccggttgtttttcctcagcgctgcttctttggacataagaccaaattcagatgctgtctccgtaagataaccagtcgtatcaggatctgcgtgatcgctgtaatgcagattcgcttcaccgtcgtgaaatgcacgtcccatttttggatgatatttcatgatttgcacacctttttgattgtatttacgcttagtataaacaaatcattttatttttatttaaaaatcagaaaggactttacgatattaaacaagaatgcttttttaatgatcatcagaaaggaggacacaatgaacaagaaatactttgtccttattgtatgtattattttcaccgcagcgctattcccgaccttttcatccgttacagcttctcaaggagaagcggtcatcgcaacagatgaaatgaacgtcagaagcggccctgggcttagctacggcattacagcggaagtaaaaaagggagaacactatccgattttaaaggaagatggagactgggtgcagatacagcttggttccggagaaaagggctgggtagtctcctggcttattacaaaggaagaccaggccagcacaaactcctcaggaagcagtggcactgtgacatcaacagaccccgatctgcggatgagaagcggcccgggcacttcatacgaagtcatcggcaaattcccgcaaggcagccaagcatctgtcattgataaagattcgggctggatcaagatatcctatcacagtgccaccggatgggtatcatctgaatatgtcacatcaggaggcagcagttcagcgtctgatgagaatgaccaaaccgaggattccggtgcgtcaacgacgggcacagtcggtgtttcttcgctaaatgtaagagcctccgcctcacatgacgcggcaattataacaaaacttgatcgcggaacgaaactgacggttctcaatgagaaaaatggctgggctcacattgaggtgaacgggctaaaaggctgggttgcaatccattaccttttgactagttctgttccagctgatgattcagcaaatgccggcagttcatcctccgctaaaaaagcctatatcatgtacggaggaacgaatctaagaagtgatgcgtcaacatcagcttcgatcgttgagcgcgctgccaaggagattcatacaccattaccggttcaaagggaagctggtatgaaataaagcttgataacgggcaaactgcttatgtagccaattgggtggtccaaacgtctaaaagcgcagaagaagcaggtgaaccgccagtctctgattccccgtctggaaacggctctctaaacaataaaacgattattgttgacccgggacatggaggaaaagacagcggaacgatcggatattcggggaaattcgagaaaaacctgacgatcaaaacggcaaaactgctcgccagcaaacttagatcggctggagcggatgtatatgtgacacgccaggatgatacctttgtcagcctgcagtcacgggtctctacgtctcactaccgcaacgctgacgcctttatcagcattcattatgacagctatgcggatacctctacaagaggcagtacagcatattactacagtcctgccaaagatcaggaactcgcatcagatgtccactcagaagtggtgaagcgttcttccattccagaccgcggcgtattattcggagattattatgtgctccgggaaaacagacagcccgcaatgctgtatgagctgggatatgtaagccatccgcaggaagaagccattgtacatagcaattcataccaagaaaaagtaacagatgggatcgaaagcggattagagaaatacttccaataaaaaaagctgccttttggcagctttttttattttgaatccataatgagcgtgaccggtcccgagtttgtaagctgaacatccatcattgctccaaacgttccggtctccactttgattcctttttcacgaagcaggtcattccatttttcataaagacctaaagctttatcgggtttggccgcgttcatgtagttcggccggcgcccttttttcgtatctccataaagcgtaaactgtgagacggataaaatctctcctcctatatctacaagagacagattcatttttccttcactgtcatcgaaaatacggagattgacaactttatcagctaaataagctgcatcatcttctgtatcgtcgtgagtgataccgaccagcaccataaggccttgtccaatttggccgacgacctcttcgtccactgtaacgcttgcttctgttactcgctgaacaactaatctcattttctaacccctttagttcatgacgcggcgcacagagtaaatatctctaatctgtttaatacgctcgacgactttatgcaagtgattgatattctggataaaaatcgccatatgaatggttgccactttattgcgatccgatttgccagagacagatgaaatatttgttttcgtttcattcactgcctggagtacctcgttcagcaatccgcggcgatcatacccaagaatctctatctcaacattgtattccttgcgcttttgaacctgtgactcatgctcccactctaccgggatcagccgctcttgggcttcattcgttttgacattcggacagtcttcgcgatggaccgaaacccctctgccttttgtgataaagccgacaatatcatcacctggcacaggattgcagcattttgataaacggacaaggaggttgtcgatgcccttgacacgaacgccagcttcccgttttcttccttgcgggtatggcttaggttccccagtgacttcctgaacgatcttttcctgttcttcctgatcgcgctgctttctctctttttctgttaggcggttcgccacctgcagagccgtaatgccgttgtaaccgaccgccgcgtacatatcctcttcatttgagaaattaaatttgtcagcaaccttttgaatattctccggcgttaaaacatccttcaattcaaaatccaagtttttaatttctttttcgaccagttcacggcctttttcgacattttcttcacgccgctgtttcttaaagaattgacggattttatgcttcgcttgggatgtttgggcaagcttcacccaatcctggctcggaccgtaggaatgcttagaggtgagaatttcaacgatatcacctgtccgaagcttatggtcaagcgtaaccatttttccgtttactttggcaccgattgttttattgccgatttcagagtgaatccggtaagaaaagtcaatcggaacagaaccggacggaagctcgattacatctccttttggcgtaaagacatacaccatgtcagagaacaaatcaattttgagcgattccataaattcttctgcatctgtcgattcattttgaaattctaaaatttcacggaaccaagaaagctttttctcaaaggttgcaccttcattggctgctttcccttctttataagcccagtgagccgctaccccgtattccgctatttcatgcatttcaaaggtgcggatctgcacttcaagcggatcgcctttaggcccaataaccgttgtatgaagtgattgatacatattcggcttcggcattgcgatataatctttgaatctgccgggcatcggtttccagcatgtgtgaatgatgccaagcaccgcgtagcagtcctttatgctattcacaagaatacggacagccagcaaatcgtaaatttcattgaattgcttgttttgcagcaccatttttcgataaatgctgtaaatatgtttcggacgtcccgagaagtcagccttgatatttacttcttcgacacgtttcttcacttcattgacaacctcatcgacataaagctcacgttctgcacgtttcttcttcatgaggttgacaattctgtaatattgctgagggttcaaataacggagcgccgtatcttccaattcccacttaatttttgaaatcccgagacgatgcgccaaaggagcaaaaatttccagcgtttcattggagattctccgctgtttttcctgaggcagatgtttcagtgtccgcatattgtgaagacgatccgccagcttgatcaatatgaccctgatatcttgagccatagcgacaaacattttgcgatgattttccgcctgctgttcctcttgagatttatatttaattttgccgagtttcgttacgccgtctacaagcattgccacttcttcggaaaatgcttctttcaggtcatcgagcgtcacatctgtatcttccacgacatcgtgcaaaaatccgcccgcgattgtggaagggtccatttcaagatcaacgagtatccccgcaacctgaatcggatgaataatatatggctcgcccgatttgcggtattgctcgcgatgagcatcttcagcgtacagatatgctttttcgacaaatgcgatatgctcatcagatagatagctgcgcgctttatctataacttgctcggcagtcaatacttgttcgttcgccatggaatcaccttttttaaaatgtaaactgtattgtagtttattatcaagaaaaaaacgaaagatgtaaagagcagaagttcaaatagccaaatattatataaaataaatgcaaaacaataggaaaaaagcaccctgacatggagtgctttttcgttatgcggttatccttagtatttcattaatgttaagatgtcgtaattttccagcttatctctgccgtcaaggtaagaaagctcgattaagaaagcgataccagcaacaacgccgccaagttcttcaacaagtttgattgtcgcttcaattgtgccgcctgtcgcaagcaggtcatctgtaataagcacacgctgaccaggcttaatcgcatctttatggatcgttaatacgtcttttccgtattccaagccataatccactttgattacttcacgaggcaacttgccttctttgcggaccggcgcaaaacctacgccaagcgcgtaagcaacgggacagccgataataaagccgcgcgcttcagggccaacgaccaaatcaatttgcttttctttcgcatattcaacaatttgatctgtggcatagcggtatacatcgcctttatccatcagtgtcgtaatatctttaaattgcacgccctctttcgggtaatccggtacaattgttacgtattgttttaaatccatctgttttatgtcctcctcgtactttcataagcctctgaatcttgtttcatcagcttattcagccattccttcagctcttcagcagaagaataattcagcttttgatccagttccatcagctgctgtttcgcctgatatgtttgtgagtctgttaagtcgcgtttctttgctccgctcacaacagacagcacaccattctctattttaacaaaaccgagatcaaaaaacacctttgtcatgaaattgattgtttcaacggaccagcctttatgttttgcaagctctgaaccgtgtttttccacgtcaaaagcgcctcttttcagcaagaacgcataataccatttaaagtggtctcttgcgggaaaagttgataaaaagtggtcctcatgattgagaaaaataaaatatatccgctcaggcgccttgccttccagcaaacgtgcgagcatgtccagcgaaggcggcggatccagtaatacaatatatgcaccatcaaggtcaaacgcctttgcttgatcctcagagctgatgacgtgcacttctcggcgaaggtcttcagtttgaagcagtgttgttgagtcttctttgaaagagacaatggcccgtttagcagatggaagggtggaaactgtgtcttcccacatccgttttccccttaagtcaaacagctgccattcagaaacagcggcatccttaatcataagctgcggcttttttcgattgttccattcgttgattgacatctcaccgacaatggaaattcttgaacccggtacgatgccttcttcaagctcgcctttattaaaaccgacgcaatcaagctgagacgactcgtttctgatcgtcattttaacatgagtcttatttgcccctatcttgcggacatcttccagtactgcgttttctacgagaacgtgcggtttcgggttcagcatgccaaaaggagacagcatgttcatttctgcgatgctttcaactgtaatgtcttcgacgccgcagacaaggtcgacttcctgtacgggaataaaatcctcttccgtaagcgtattgtccgctatttcattcagcctgcttcgcaaatccggcacatcttcggctttcagcgtcatccccgcagccattggatggccgccgaaatgaggaagaatatctctgcattcagaaaggctctcaaataaattaaatcctctgatgcttcgggccgaacctttagcgattcccttttcttcatcaatgcctagaacaatggccggtcggtagaaacggtccacaagctttgaagccacaattccgacgactcccgggttccatccggctttggccacgacaattgcagtttgatcgagcccttgctgtttaaccatttcaatcgcttcatccgtcattttgctgaccattttttggcgctctttgttcagctggtcaatttctgcggcaagctcttccgcttcaaacgaatcctctgacataagcaaatgaacagcgggatccgcctgttcgattcttccgacggcattcagccttggtgcgagctgaaatccgactgtttcttcgttcgcttctccgatgtctccgcctgacagcttaatcagctcttttaagccgagccgatttgtccgtcgaagcctttcaagtcctagtgttgcaattaatctgttttcgtcatgcagcgggactagatcggcaatggtgccgatagccgccaggtcaagcagttcatcaggaagttcacccaataaagcgtgggcaagcttaaaagcgactccaaccccggcaagctctttaaacgggtaagtgcagccaggctgcttcgggtggacgatcgcatggacatccggaagctccggtcccggttcatgatgatcggtaatgatgacatctagtccgagttcctttgccaccttcgcttcatgcacagcggcaattcctgtatcaaccgtaatgatcaaagagaagccccgttctttaatcgaacgaaacgcctgttcattaggtccatatccttctttaaaacggtcaggtatataaaaatcaacttgagccgacagtttttgcagcgtgtgaagcatcactgacgtacttgtaaccccatcggcgtcataatcgccatatatcataatcttttcttgttgtgaaatcgcctgttttattcgatctgccgcttctttcatgcctttcatttcaaaaggatcataaaaatcggcatcctttgtatgtaaaaacagcctagcgctttctgccgtatcaaagcctctttttacaagcagggacgcaacaagaggtgttatatgcaattgttctgtgagtgatttgaccttatcctgatctggtcgctggatttcccatcgcatttttgacgctaacataaattcacccctcaaccaccctattatactagagcaggctgaggggtttcaaataatattcgaaaactagtcttttttctcaatcatagctgatgcatcctgtgtgtcagtctgatcagcaagatgagtatcctcttgtttatgtattgctgttctattttctttccgcaaggtttttatttcccgcttcaatttcattacctgaaaaatgccgacagaaaatacgatcagcgctcccattaaaactgagcccaaaataacaagaatgagcggccattctgatcttccaaacaggtaatcaacttctacggatcgaacattaatgactgcgaaaatagcgacaattaaggtgaaaataagtgcgaaaataatggtccattgtttattcattctcttttccccaaacttcttattgaggtaactttccccatcaagactggttttaaacatggcttaacactgggttaagctccctttgttgttaatttttcctggattagcctcttcagtccggttccctcaccggaaatcacaagtgtatcgccttcgtcaatgactgtttcagagctcggattcagttgtttatcctgattcttcttaataattgcaatgaccgtcacatgatattcctgacccacattcaaatcaccaatcgtctgatgaatggcaggcgctcccgcctctgctttacaccactctataatcaaatcatcaagggctgactcgacctgttctaatgctttcggtttataggccattccgccaagaattgcagacatttgccttgcttcagcgtcatcaaactgcacggaggcaacacattcctcatggtcgttttcgtcaaaatagtaaagctctctccgtccgtcatgatgaatgataatcgaaattttatcacggtttctagtaatcatttcaactttttgtcctatgcccggcagctctgattcgcgaaccctcatatataaaccctcctacatatctgaaaaccagtcataaacacttttaacaccatatatatgtttaaatgtaagcgtatgtcattatagcaaatgtctattttaagttcaatgcaacttcaaaaaacaggctgccctgcagaggacagcctgatattttttattgcgccgaatcttttttcagttctcttcctttccatgcaagccaaatttgtgcggcaatgtatagagaagaataaacgcctgttaacagcccgaccaataaagcaattgagaagttagtaatagaagatgctccaaagatcagcaatgtcacaacaacaatcacaacagttaatacagtgttaattgaacgtgtaaaagtttgctgcaggctcaggtttacaatatggttcagatcggcaaatgttttcggcttacgctttttcatatgctcgcggaccctgtcaaatgtaacgattgtatcgttaatggaatacccgattatcgtcaagatggccgcgatgaacgtaacatctacctcaagccttgtaatactgaagaacgtgacgataaagaatgcgtcatatagcaatgaggcgatggcagcaatcgccattttgtattcgaatcggattgaaacgtaaataatgatgccaatagaagctatagcaactgcgtacagcgcatttcttgccagctccttaccgactgtcggtgaaactgtgctgacatttggctcagacccgtatttgtctttaaaatacgtttttacttttgctatggtttctttatctggcaccccgacaaaacgggcaacaccgatattgctcttttcgcctgacagaacgacagtatcagggtccataccaagagattcaaagtccttttcaacttgctctgtcgtcagcttatggtcgctttgtacttcaatccgtgcaccgcttgcaaagtcaatgccaagattcagcctgaacacaagcaggataataatcccggcaaccgtgactgcactggagaaaataaagaagtatttgcgtttgctcgtgaaatcccatttttggaatggcgtatgcggctctgtattttcatccgtatcctgaatatccatgatatgtttcttattgacaccaaaccagccttttttccgatcaagccatctgctttccacaaggagagcgaggagaaatctcgataagaaaacggcagtgataaagcttgtcaaaatcgataggatcagcattgtcgcaaaccctttaacagagcttgtcccaaagataaagagcacaaccgctgcaataatggttgtaatattcgcatcaaaaatcgtcgcaaatgaccgtctgtttcctgaacggaaggcagagcggactgactttcctagcttgagctcttctttaatccgctcataggtaataatgttggcgtcaacagccatcccgacacctaaaatgagagcggcaattcccggaagcgtgagtacggcattcatccagtcaaagatctggagagtaatgtagatataaacagatagcgtaatcaccgcgattaaccccggcagacggtaatagaaaagcataaataagaaaataattgcgataccgacaataccggcaaacaccgtatcatggagagcctgctggccgaattgtgcgcctactgatgtcgaatatttttcagtcagtttcacaggaagtgcacctgcgtttaaaatgctggctaaatcttttgcttcttgaaccgtaaattgcccttcaattgtaacgtcagttgtgtttaattcctgacttacatttggggcggatacatatttagggtgctctttttgaacctcttttttaaaggagtcccctttttcgtaatccatccaaataacaagctggttgtttggcgccattttcatgacctttttggtcacttcgccgaatttatcagcatctttcagtttaatgctgacaatcggttcatttgttttggcgtcatacgtttgtttagctccgttttcgacgaggtcagagccattcagcaattctttgtcattcgtatctctgaaagaaagctgcgcttcagtcgccaaaatttcacgcgctctgttttggtttgtcacaccagcgagctgaacgcgaatccggttattcccttcaatttggatgttcggttcgctgacaccgagaacattggcccggcggttcaatgcctctactgtgctgaccagaacatcttttgtgattttgtcacctttttttacaggctgtacatcatacagcacctcaaatccgccttgcaaatccaatcctaacgtaatattgttagcggcaggcttcgtaaagtagcccaagcccgtgccgatcaatagaacgaaaaggaaaaacgcaatcaagcgtccttttttcattatgtatatcctcccttaaacctgtgcgaatcaacctgctatctcagcagttcttccaatgcttcctggccctcttcactgcccagccaattagacgttttaaatgactcaacggttgcatagttcataaattcgccaattttcactgataaaatatcactcgcaagttcataaatgttcagttccgttttctttttccacttcttatctgttaagtatgaccacaaactttcgagttcaacatcatcatacccgagaatcttaaactcttccagtttgctgtaaagaaacggcctgacgtggtctttatatagatcggctggatgcttctccacgaattccacgctccttttttattgtttttcaagaagacttgtcatgcttggacgatatatacgcatatctttattgtatatgattccaggtagtttgagaaggcagggggtaaaaatggcgaaacagacgtttttaaagggcactcttatccttatcgcagcaggaatggttacaagaatgctcgggtttgtcaaccgggtggttatcgcccgttttatcggtgaagaaggagtcgggctttacatgatggcggcgcctaccttcttcttggccactacattaactcaattcggtctgccggtcgcgatcagcaagctagtcgctgaagccagtgcgcgcggagatcatcaaaaaacgaaaaatattttagtcatgtctctgaccatcacgggagtgctcagtctcatctttacaccgctgtttctgtttttcgccccggttatggctgaaacgatgctgacagataagcgaacactgtatccgctcttggccattacgccggttgtgccgattattgctatatcgagtgtgctgaggggatactttcaaggaaaacagaatatgaacccgcttgctatgtcacaagtccttgaacaggttgtccgcatttcactcgtggctgtctgcacaacgatttttctcccttacggaattgaatatgctgcagcgggggcaatgctatcctcagtggcaggggagctggcatcacttctttatttattcgtttgctttaagtataaaaagacaattaaaatcagaaagcattttttccagtcaattaaaagcggaaaacaaacctttacccaattaatgagcgtgtcccttccaacaaccgggagccgctttatcggaaacctctcttggtttttcgagccaatcgtcgtcgctcaaagccttgccatcgccggtgtggcaacagttgccgcaacaaagcaatacggggaactgaccggctttgccatgacgctgctgactctgcccagctttattacatattctttgtcgaccgcgcttgttcctgcgatcagtgaaggaatggagcagaaaaaattgcaggtggtggaataccgcttggaacaggcgatgcgtctctgtctgctcagcggaggcatttcagttgttattttatttgtatttgcggatgagctgatgagagtgatgtacggttcctcaggcgcagctgtatttataaaagtgatggccccgttttttctgctttattatttccaaggcccgcttcaagctgtgctgcaggcgcttaatttggcaggagctgcgatgatgaacagcttaatcggagcgcttgtcaaaacaggccttatttttgtccttgccacaaggccttctcttggcattatgggcgcggcattagccattgtgacaggcatggtgctcgtcaccctattgcacgcagcaaccgtaagcaaagtgctgccgatcagcatcaaaatcaaggagtacgcgctcagcttcgctgttattgtaatttgcggattcatcagctccgccatcaaacaatatataagctttggagcatctgaggctgtcaatctagccggatggattgcggcgagcgccgccatttatatgatcctcctgctcgttttccgtttaattaaaaaagatgagcttcgccgcattcccattatcggacggttgatcatccgataatggtcacgtgcggtgcccatctttttcatcaatatatatttctccgtctgtaaacgagcaaaatgaaatatctgaagggttgttgtatccgtgtttttgcaaattttcaagcagccattttttatctttactgattctggacaggttttctgtttgaatgaagccatctataatgagcggcatttcgagctgccgatgctctccgctattttctttctttacaatagtcagtttgcccgacggctctaaaatggcaaatgatacgtcagctactctgtcgacgctattttctctgagctgaaccattaaatcatcaaaattataacgctgtgatttcatggcttcttcgtcaatttttccatatttgataattatggtcggcttaccgtcaagaagctggcggacttttcggttttttaaagaaaagtatgccaaagtcacttgaatgatcattaatacaagcattggcaaaatggtatgaaatagatgatcgtctacgttttctatggctaaaacggcaatttcagccatcatgataaagacaacgagatctaaaatactaagctctccgatctcccgtttgcccatgaaacgaaaaatgaccaatatcacaaaatacaatacgactgtgcgaaacgcaatagtgagaagctcttccattatgcacctccaactcattataggttgcaacaaaatgatcaatttatgtaagaaaaaccgattgcatttcacaaagcttttacgtctaattcatgggataagggaatacatttttacaaagacgagccatcagcatgtctgacggttttgaacaaaaagaacagaagccttttaatacaggcagagaggagacaatcatggaggaaacgaaacaagttggaaaaggcattctttacggcttaatcgccatattttcagccatgctcctgacaagtttagcggtttcacttttattgaccgcaacctcgctggaagaatcatcatttaactggctgatcaccgctatctcatttctctctttatttattggcggattcatttcaggcgggaaaggcaaggaaagaggctggatgattggcgcattgaccgccttaagtttttctctgattatcttattgtttcagtatttaggattcggaaagacatttacagcagaacagctgatcttccatctgggatttttaggggtgtgcatgctgggcgggattttcggcgtgaacatgaggggaaacaggtcttccacataaaaaagagcgggctcacccgctctttcagcatgtcgacaaaccctcgcattcgttgtcaggcctacgttccggtactcacgaatttatacattcgctgcgctccggtactcggccttcctagacttcaagggttttcaatcttgctgaaaagatgacaaaaaagagcgggctcactcgcccgctcttttttgtttgctatgtatagctcctgctgttattcagcagcagaaacttctctgatcgcgcggcggtcgaacgtaagacgtgtgttatcaccagtcttaattacgactttgctttcgtcgatagagtcaacagtaccgtgcaatcccccgattgtcactactgaatcgccttttttcagttcctcttgcatttggcgtacagccttttgctgcttttgctgaggacgaatcagcaagaagtaaaggaccgcaaacattaaaataataggaaccaatgtacctaaagtgccagtcatcattttcacccctttctgtaagcctgttatgttttatttagaagcttttcgcatttggcttgttatagccgtaacgctcaaagaactcttctctgaaatcacccagacgatcctcgcgaatagcctgtcttacctgctccattaagtgtaacagaaaatgaaggttatggtaagttgttaatcgaaggccgaatgtttcattgcagcgaatcaagtgcctaatgtacgcgcgagtatagtttttacatgtatagcaatcacactcttcatcaatcggacggaagtctctttcaaatttcgcatttttcatattgagtcgtccttcagcagtaaacactgtgccgtttcttgcaattcgagtaggcagcacacagtcaaacatgtcgaccccgcggatcgctccgtcgatcagtgcgtccggagaacctactcccatcagatatctcggtttatccttcggcaagagcggtgttgtaaattcgagtacacgattcatgacatccttcggttcacctacagacaatccgcctatagcatatcccggaaaatcaagggaaatcaagtccttcgcactttgtgtccgcagatcttcatattctccgccttgtacaataccaaacagcccttgttcatcctgacgattgtgggcattcaggcagcgttccgcccagcggcttgtccgctcaactgaccgcttcatgtagtcgtactccgccgggtatggcgggcattcgtcaaacgccatcataatatcagagccgagtgcgttttggatctccatcgctttttccggagataaaaacagcttgtctccatttagatgattgcggaaatggacaccctcttcctctatattacgaaacttgcttaaagaaaagacctgaaaaccgcctgaatctgttaaaattgcgcggtcccagttcataaatttatggagcccgcccgcttctttgacaatgtcttggcccggacgaagccatagatgataagtgttgctcaaaatgatgcctgcatccattgctttcagctcttcaggcgacattgttttgactgtcgccagtgtgccgaccggcataaaaaccggcgtttcaaaggagccgtgaggcgtatgcactttgcccagccgcgctcctgtttgtttgcattcttttataaattcatagcgtattggttgttcagccacttttgatgaggcctcctgttctcaaattatataatcagcatcgcgtctccgaagctgaagaaacggtattcctcttccactgcatggttataggcacgcagaatgttttctcttccagcaagcgcgctgaccagcataatcaatgacgatttcggcaaatggaagtttgtaatcattccgtcaatggctttaaattcatagcccggataaataaaaatagatgtccagccgcttgatgctttaaattgcccgtcatgttccccggcaatcgtctcaagcgtgcgtgtcgaggtcgtaccgacagaaatgatccggccgccattttctcttactttgtttaaggctgcagccgtttcttctgacatttgataaaactctgcatgcatattatgctcttccacttcatcggcactcacagggcgaaacgttccaaggcctacgtgcagtgtgatgaactcaatttgcacgcctttgtctttcagctgctgtaagatttcttccgtgaagtgaaggccagctgtaggcgcagcagcagagccgatttcttttgaatacactgtctggtagcgctctttgtcatcaagctgttctttgatatatggagggagcggcatctctccaagggattcaagcacctcgtagaaaataccgtcatattgaaattccatctttctgccgccgtgctcaagctcttccgtgcagattgccttcaatcttccgtctccaaatgtgacaacagttccttttttcacccgtttcgccggtttggcaagtgtttcccatttatcaccggtttcctgtttcagcaaaagaagttccactttcgcgccggtatcctcttttgtgccgaataaccgcgcaggcagtacccgggtattgttcaggacaagacaatcgccttcgttaaagaagctgataatgtgtttaaacgagctgtcagtaagctctcctgtatgtttatcgagcaccatcagccttgaagcatcacgctgctccaacggtacttgtgcaattaaacgttctggtagttcaaaatcaaataaatcgactttcatgatgatttcacctttattctagtcttttgttatttcattctgccaaaaagattgagcaaaattgataataccacacttataataatacaagtgacaaccgggaagaaaaacgtgacatttcctttttttacaaaaatatctcccggcatcttgccgacaaaatgcaaaactgctccgataataagcaaaacagcaccaagaatcataatgatcttaggaaattcagtcatatcggggagcctccatttggaaatgatgataaacggccggtgtcacgatccttccacgcggcgttctttgtataaatccaatttgcagcagatatggttcatatacgtcttcaatcgtatgcgattcctcgccgatggtagctgaaatcgtatcaagacctactgggccgccgttgaatttttcgatcatgcccatcagcagcttatgatcaatatgatccaaaccgaggcggtcaacctgaagccgctccagcgcattctgagaaatgtcttccgtaatcctgctgtcacccagcacttgggcgaaatcgcgcacccttctcagcaggcggttcgccacgcggggcgtccctctcgatcttcttgcaatttcaagagccgacggtttatcaatctcaacctcgaatacatcagcggttcttgtgacaatatccgccagttcttcttgtgtatagtactcaaggcgagacatgacgccgaatctgtctcttaaaggagccgtcaaaagccccaccctcgtcgtggctcccaccagcgtaaaaggcggaaggtcgagccgaaccgagcgggcagatgggcctttgccaatcacaatgtccaggcaaaagtcttccattgcaggataaagcacctcttcgatcgatctgtgcagcctatgtatttcatcaataaataatacatctcccggttccagcgccgttaatatagcagccaaatcaccaggcctttcaatcgcaggccctgatgtcgtccgcaattccactcccatttcattagcaacaatcgaagcaagcgttgtttttccgagtccgggcggcccgtacagaagaacatgatccagcgtctcctgtctcattttcgccgcatctataaacacgcgcaaattttcttttaccttatgctgcccgatatactgtgccagattttgcggcctcaggctttgctctatcactgattcatggttgtctgcttcacttgagacgagccgttcatccatgaacatcaccttactttaatagtttttgtaatgcttttttcacatattggtctgttgtcagcccaatttcttctttaaggtgaggaagcacctttttgatttctttttcagcatatccgagaaccctgagggcttcaagtgcttcttcaagagccgtttccgctgtttgcttttcaagcctttcttcatgattaaacagattttcaatcatttcaggcacaacatctgccagctttccttttaaatctagaataatctggcgtgcggttttctttcctactccaggaaacttgaccaaaaaagcttcatcctcattttcaattgcttggatgaccgctccgggatcacccgagcccaagatggcaagtgctcctttcgggccaattccggtcacgtttaacagctttgtaaagagcgccttctcctctcttgttgaaaaaccgtaaagcgaaaaagcatcctctctgatatgatggtatgtaaaaatcgtttcttggcttctctccttatatataaacggattcggcgtgaaaatctgatagccgatgccgccgttctctatgacaatatattggggagatacataatcaatcgtccctttaacaaattcaatcacgcaaattcacctctttgactgttcttcattgtaccataaaaacagccaaagtcttatagaaaagttaacatatgttcgcttctctctcattctttcacgaaaaaaaagacatgaatacatgtcttcaatcagcggacgttacccgctgtatgtcttcatatgttcgatgacatcctcaaactccgcttttgtccgaaatggaatgcctttcagcagatttttttgcatatggctttccagcctttctaaatcaatttgaaaaaaagactgaattggttcggaagctggctcaggccgcccatgaaaagtggaaatcactccattatccgatacaccgatatacccgttgaccttgctgagcggagaaatatcgtccatttgcttccggaagagcacatatccctttttttgttccacaagcgtccatccggcataagctgcccaaaaatcatccatagaaaacactttttcatgcttatgctcaatgctgacatcgccgtccaaatacaccttttcaagctgcacatgcacctgcagcggctcatagtgctccacttccgcgccaagtgcgcgggaaggagctcctattaaaaatactgccgctgagcaaagaatgcccagcaaaagatacgccgtgctgaatcgtttcaccctctacacctctttgcacacgtttatgattagtttgaccaaagaggctactgcttaaccgttttatcaaaatttgtctgcacattttccctgacaaaccgttcctccgtatacacatctgtgctttgctcagaaattgtcaagaatcgcgtcagaaaggcactgaaaaaatacaatgccgcaaagatccaaattacgccgcctgcaccgagcggcccaatgaaaagactcacgatgcccggcgcaataaacgcacataaaccagatcccagattcaacactgacatggcagcgcctttattatcaggtgcaagcgtcggcaaaagcgcgcttaatggaacgtagcctgctaaagccgcaccgtagcagcaggcgataatcatgagcacccaatactgatgcccgatcagctgaggcgtgtaatacagcgccagcgtaaaaataccgcatccgacaccgccaaaccacatgaccgtattgcgccagccaagtttatctccgactgcaccgaaaatgatattaaacacaatattcacaaaaaacagcgtcccccatatttgcagccattccgaaaccgaatacccgtatcgtgctaaataagtaggaagaaagatggcaaatccaaattgtcctatcgcattaatcgtcttgaccactccgccgatgcctaccttagggttttcaaacataattgtaaatgccttcgacaattctttccatttcggctgatcttgtttttgtatcggagtaaatttatctttgttaaaaaataaggcaagaattccgcctgccgccacaaacagtaaagcgctccaaagcgtattgatttctccaaaggccggaaccgcatagctggaatagaacgggccgagcacgttaaggccgcacgtaaacataaaccaaaaccatccgacggcttttccgagaatattttgagaggtgctgtatgacacccatacgagaaaagagtatgcaaacagcggatatcccaagcctctaagagcatagctgcccaagagagccggataatacataagaggaatcgcccagccgataaaagcggccgaaccgaggataaatgcaagcaatccgacagtcatcgtttttctcggccccaagtttggacaaacgttcctgaaagccaagctgagatggtgacagcaatgccgtacatggtaaataacgatgcggattgctgcatactgagaccatgatcaacgagaaaaggagacagccagccttgttcgaggccgtctccaaccataaagatgacaacgccaatataaccccaaaccatgtgagaaggaattccgattttgttcaaaacatttcctttagcatgtactgtattcattttctccaccgcctacttaaagtatcaatggagtatatacccaagcttgctgaattgtaatcctgttagattaaaaagcgattttttcagtgtgctcaatgctgacaggcatgccaaaagcaagcgattgctgtgctgctctggcgatccttccggcctgtaaaccgtcattaccggtgcagggagtctcctggtttgtgccgatcgcttctgcaaaacggagaatctcctcctcatatgaatccttatagcgttcaaggaaaaagaaatgcggtttatccttcatcacaaaatcagctgttgacacctcaaccgttgtcggcctgctattgtcagccgctgcagagcctttcgtcccgaaaacctcaacccgctggtcatatccgtacacagcttggcggctgttatcaatcacagccatggcaccgttttcaaaagtcagtgtaataacagctgtatcaatatcacccagctccgcaaaagaaggattcaccaaagccgcccctttggcatacacttccgtcacttcgctccccaaaatatatctggccatatcaaaatcatggatcgacatatccataaacaacccgcctgacgtacggacataatctatattcgggggttctgggtcccgagaagtgatttttaataaatgaggcgtaccgatttcaccattttcaacaatcgttttgattttcttaaaatgaggatcaaagcggcggttaaatccgacttgaagtgttaccccgtgtttccggacagccgcaagcgcttcactcgtttcgtccagagagaaactaacgggcttctcacaaaatatatgctttttcgcctcggctgcttctttgatcatctgtgcatgtacggctgtaggagagcaaataaaaatagcatcaatatcaggatcatgtaataaatcacgataatcagaggttatgtattcaatctgatgactgtcggcccagctttttatacggcttgcctgagtgtcagagactgcttttattttcatgtgaggaatccggcttatattttgaacatgaagtttgccgatgcggcctgcaccgataatccctgtcacaatctgttttgtcatggcttcttcccccttgatcattcacgaaagcgctttatttaaaattaatactatcccatttgtaagcgcttttcaagaatggaaattaaaccttctatgtctcttttatcacaattcatgcttataagtagccttcttcttcaagaccagatacactagaattaggctatttttcctgaacagtttatgattttcctataaacagctgcataaaatagagcaaagaaggtgaatgaaatgctgacaaaagcagaggcactggcccattccgtcatataccgcaagaacagcagatttgataaagtcaaagagaaatccgaggaattaacactaatcggcaagggaagaagcgcctatgtgtttgccttaacagaaggcggtcgaaaaatggcgctgaaagtattttttccggaatatcaagcgacagcagtcaaagaagcagcgatctatgaaaaattagccgggtccgcattctatcctgacatttacgaaactggcgattcatttattctcatggaatatattaaaggtgaaaccttttataactgtctgaagaaaggcattgcgatcagtgatgacatgattcagcaggttgaagaagcactttctgacgcccgggctgccggcctgaacccgtcagatatccatttgcggaatctgattctgacagaaaccggagcagtgcgggtgattgatgttgcgagatttgaacagacaaaaacgtgcacgcagtggaatgatttaaaatcagcgtatcatgcactctacaaaaaaccgatattccccaaaaagattccgggtttttggctggagatcatcgcatttttatataagaaagattggtttcaaaagcatttcgcacagcggaaaagaaaatattcttaaatcaaaaaggcagccgcacaagcggctgcctttatcatgtattttttactttctgacggcagaaatcagtttcatttgttcaggcgacagcttaattcgatagcttctcacagttaagtagaccgcttctgggtccttctcgccggaatgacaatacgttttttccatttctgtctcccctcaccctttattggctttatttcatcttatcattgctttattgaggtaattttaaagaaatgtaaagattatatgaatccgatatatagtaaaatgagagaaaaaaagggagagagtcacattaagacacgcagcaacatcccgcttattatgtttgccctgctggtcttcttcggcggcgccatctattggatgttattttcactaaaaaacgttccgaaaggaaatttcgtccaatcggttaaatcgccggacggcagctatacgttaaacacttatgtatccgaaaacaccttgagcttagatgcagccagaggtgaacttgtaaatgaaaaaacacttgtcaagagaacaatctactggaattacccagacagccgcccagcagtgacgtggatcaatcacaatacagtgaaaatcggcaatcagactttacatcttgatactgatgaaacatatgattggcgaaaagatgatcattggatccgtgaagaaccgccgcaggcgtcagtgaggtgatgaaacatgaataagatgaacggaacaaatgatgacaagcatttcaatcattttgtgattgctttatcctttatatacggtttgactgaactaggctatttgttgctgaaggattttataacaattgccataagtttgcctctgtagaaaaacgcagcgtagtcgatacgccgcgttttttctttttcccttcctcttcttattgataattacaggtcatataatgtgacaaatcgattgtagaaatagttcgattagaccaaaatcctttttatacatgtattcgaatttgaagtgagggggaagcttgatggcagattttgttgctagtttgaatgcggtcttatggagtacgcccgtcatttatattttattgggaattggattcgccttttcaattatgacccgttttttacaagtccgacatttaaaagaaatgattgttcagatgttcaaaggcaagagctctgaagccggcgtttcatctttccaagcgttatcgattgcgctgtccggccgtgtgggcacaggaaacatcgcgggagtggcgacagcaattgcattcggcggacccggtgcggtgttctggatgtgggcgattgcctttatcggggcggcgagtgcctttgtagaatcaacacttgctcaaatttacaaagtaaaacaagacggtcaatatcggggcggccctgcttattatatagaaaaaggcttaggcattaagtggtttgccgtcttatttgccgctgctgcccttattgcaatggcctttctaatgccaggcgtacagtccaactccattgcggctgggatccaaaatgcattcggcatctctcctttcgtcacagggtgcggtctggttttattattagggtttattatttttgcggcgtcaaacgaattgccagtgcggcgcaaatgattgttccatttatggccattggatatatcctgctgtctttgattattattgtcatgaatgtgtctgaattacctgctgtgctctcattaatattcaaaagcgcctttgcattggattccgcttttggcggcttgatcggcatggcgatttcctggggcgttaaacgtggcatttactcaaacgaagccggccagggaacaggcccgcatccggcagccgctgcagaagtttctcatccggtcaagcagggactggttcaggcattttctgtttatattgacaccttgtttgtatgttccgctacagctttcatgatcttgtttaccggcatgtacaatacccaggctgcagatggttcctttatcgttcaccagcttaaagacgtagaagcaggacctggtttcacacaagcggcaattgacagtgttcttcccggattcggtgcaggctttgttgccatcgctttattcttcttcgcttttacaacaattatggcgtattactacatcgcagaaacaaatatcgcctatttagcacgaggcagagaaagcaaatgggcaatgcttggcttaaaactgattattttagccgccacattctatggtactgtgaaaacagcttcacttgcttgggcattaggggatgcagggcttggcattatggtatggctgaacgtcattgccattgtgctgctggccaaaccggcgcttcttgctttaaaggattatgagcgccaaaagaagcagggcttagacccggtctttgatccaaaagcgctgggtatcaaaaacgctgatttctgggagaaagaatacactcatgatagtgaacgtgtctcctgaactactaaaaccggcccgatatgacatcgtgccggttttttatgagcgatagtttgtatacacttcttgaacatcatcgtcatcttcaaggatgtctattaatgtttccagcttctcaacagcctgatcatcggcatctgcataggtattgggaagcatggtcacctccgccgaagaaattggatatttcgattcgagggctgttttcacctcttcaaaatgctcaggctctgtgaaaacctcatataggtcttcttcaattcgcagctcttctcctcctgcttcaagcacatcaagcatgagctcatcttcttctatttgccgttcagtgcggtctatcgtaatgaaacccttccgttcaaataaaaaggctacacatccgctttctcccagacttccgccatttttattaaaggctgtccgcacatttgacgccgttcggtttttattatctgttacgcattcaaccatgacggcaatccctgaagggccgtagccttcataggtgatttcttcataactgcttccatcttggcctcccgcagcttttttaatggcccgatctatattttcattcggcatattggcgccttttgctttttcgatgacaagacgcaatgctgaatttgcttctggatccgctccgccttctttcgctgccacatagatttcttttgccagcttcataaatattttgccgcgctttgcatcctgtgcattttttcttttttgaatgtttttccacttggaatggcctgccatgttttcaccttcttttacattttctatgtacactttaatgggaattgttcgctgatgcaaagaaaaaggctgccgaatatcacttccggcagcccttccttcctagcggttgttcattttatgaagttttctgaacagccctttatctgttgatacttgaacgtcacggccatttgcatagttgcgcgctgcttttacgacattatctctgtcagactttgtgaactctctgtggcttttgactgcgataactactcggtcatccgataccataacttgtgtgtcattgacgtttttcacttgtttcacacggttggcaatttttgcagccagtcttctgttttcttggttgtcatacccgttgttcgctgcattccgattcatgtttcggttattcgtgttgttatatgttccgtcagttgccaaaggaacacgatcgtcagcagtaacacggtcacggttatttacattcgtggtgtttcggttaccgtcgttctgatcctccattaattcagaaacaggaccatcgtggtcgattccgtctccctgtctatcggcgtcattttcatttgtataatatccgattggacgggtattgccgttattgcgcgtatcattcatagcattatcgtttgctccgcatgctgttaagccggctgtcattagaatcaggctagcgatcgtcatttttttacccaatggaaaaacccccgtggacgaattgagcatgtttgctcgcttttatcatgtgcgtatggggggcatgttaagcgtgtcagttctctccatttggcagtgatctgcttgaaaacaaaaaaaggaacgatttacatcgttccgaacgatcactcattttcttcttccggccggccaaacatttggtttacagaaggctgattcgtcattggcatagaaactcctgccgaatatgggtttggatttgggttagctgtgccatatggcatattagggcttccataagctcccattcccgaatggccaggtgcagagaaatatggctgatgatcaccgtcacagccgcagtcgtcatgatctttgtatggcatgtaaccatgagccgcagcaggctggtatgctcccattacttggggagtgccgtaataagggccatacggcatatgtccatacggagatccataagccggagatgcgtattgcggcgcaccgtatgaaccgtaatgtccgtgatggctgttttcatgatgctggttttcataacccgggtcatactgagacgatacaaagcctggctggtatccatgcatcggatgcattggataagcttgtgccggatagtacggatagcataatcctgatcctggaagaattggcgaaacaggcaccggacacggtacgaaatgagccggataatgataataaggctgaacagccggcatcggcatattcggaactgtgtgatgaacgttttcctcttctataccgcctacctctggcgcctttggcatattaggcatattcggataatttgcattttccatattactcatagcctcctgttgtggaaattggtcttgcatatgatacatatgatccatatttccgtcatgatgttttttcggctcctccggtttaggaggcgaccaaggctggaaaagctgtttcatatcataataatcgttcacatcagcttcagggtacacattttcctgcaaattaggcatcggcgggacatacggcatggacttcttttctttcggctttgtgtcttctacatcgacaacggatttaggcttctctttcgcatatggatgttcttgcttcacactcccggccgcaggacttttgcccgcttttggctcttttctgaccgggactccttctgacggcacttttattttcattccaggcatgattaagtctggattgctaagctgtgtattgagttttttcacttcctcaacatcgactccgtacttttcagctattttccagagcgaatcgcctttttgaacgatatggattttcaacgttttcccctcctatgcaaaacgtgaacagttcagctgtgattacaatatgtttcttcacaacatatgcctgaacaaaagaagttatgagtaaaggaagggaaaatatttctgatctacgtgatcgaaagcattcgattcagggcaaggagtgcatcttcctgaatggcttttggcaccttgatgacgcctgaaggttctcctttttcaatttgttccagcgaccacaacaaatgcggcaaatcaattcggttcattgtcaggcaagggcacatgtcagggttgagtgattcgatttgtttatctggatgctcgtgaatgatccgctgaacaagattcatttctgtcccgattgcccacttgcttcccgccggagcctgattgattgtgtcgataatatatttcgttgatccgttatcatcgcttagtgtcacgacttcgtgtgagcattccgggtgcacaatgatctgaatgtcggggtctcgctctctcatatcatggatatttttagtggtgaatttctcgtgaacagagcaatgccctttccacaaaatcactttcacattcgtatgcccggatacagctactaattcatctttcatcgggtcccacacagccatatcttcaagcgcaatgcccagatcataagccgtatttctccctaaatgctgatcaggcaaaaataaaattctttttttctgtgtaaacgcccattcaagcacttttttcgcattcgaagaagtcacagttgctccgccatgctttccgacgaatgccttgatctccgcagtggagttcacataagttaaaggtatgatcgtatctccaaatatatgctgaagcttcttccatgccctattggtctgctgcatgtcagccatgtcagccatagaacatccagctctcatatctggcaggacgaccgtttgctgctcgcttgtcagcatatcggcggtttctgccataaagtgaacaccgcaaaatacgatataatccgcatctttgtttttttccgctacttgggccaattgcagggagtcgcctgtttggtcagcaaattgtatcacttcatccttttgataatgatggcctggtataaagagcctgctgccgaactttttcttaatggcggcaacgcgcgtttccatatcctttctcgatagttctttataactttcgggcatcatatcattcgattgtttgatcacatcaagaattgacataacggcattcctccacagattcatttgataacgtaacatccatgctgatatctaaacttttgacggaatgagtcagaaatcctaatgaaatataattcacacccgtccctttaaaagcaggcaaagattctaacgtaatcccgccggaggcttcagtttttatatgatccggtgtgagctttgcaaaatgacggaccgtatcaggcgggcagttgtcaaacataataacatccgcgccagctgcaattgcttcccgcagctgttcctccgtttcaatttccacctcgatatttaccatgtgtcccgcggcctgacgggcttttttgcacgcctctaaaatagaaccgcatgctgcgatatgattatctttaatcatgatgccgtcatacaaaccgaatcgatgattatacccgccgccggctctgacagcatatttctccagcattctgagccccggtgttgtttttctcgtgtcacaaattttaatctgttcatcatccagacaccgaacagcctctcttgtcattgtcgcaattcctgacagcctctgaataagatttaatacgacccgctctcctgaaaggagcgcagctgcgggaccgtgtaactcggcaatcacttcacctttatgcaacatgtccccatcttttttgtgtaaaatgatttgaacattttcgtccaataacgaaaagccttcttttatgatcgctgctcctgcaaaaatgccctctgactttgcaacaatctccgcttcacagctctgttctccaaaaatagactgcgatgtaagatcccctgtcccaatatcctcaagaaaaaagtgattcagtaattttttcagctgtaaatgattcattgttccaaatcccctcgttttttctgatcttcgttcctttttttgtatggacaatttgtcttccttgccagcccacctcagtatgaggaaaatcggtgcggaagtgagcccctctgctttcctcccgcaaaagcgcagaaaacgtcatcagctttgcagcttgccatagatgagaaagctccagctgcggaattgtgatatccttcacattcacttcctgaaaaggcagcgtatgaagccagatgctaagctcaatcaaactgctttgttcccgcagaatagacatgtgacttgtcattttactttgcagttcatgcatctctatatccggcacctcgtagacgacactggtttctagccctgattgatattgcctgttataaaccggtttttggataatatgctctgctgccctttttccaaataccagcgcttccaataaagaattgcttgcaagccggtttgctccatgtaaaccggagcatgctgtctcgccaatcgcataaagtcccggcactgtcgtttctccccagcgattaactgaaacacctcccattaagaaatgcattcccggagcaacaggaatttttccgctgtggatatcaacccctgctttttcacaaatagcggtgatggtagggaaacgcgtttcaaaatcagaaatcgcactgaagtctatataaacgcgatttccttttgccatttcttcgtgaataacccgtgagacaatatctcttggagccaggtcacctaaaggatgccgttcagccataatcctgcggccattttcgtctactaaacatccgccttcccctctgacagcttctgaaacaagcccgtaggaaacaccatttttcacaagcagtgtcgggtgaaactgagtaaactccaaatccgttaattccgctccggcccggtaagccagagaaagaccgtcagctgtgacagtgggatcattcgtatggtgaagaaacaggtttccacagccgccggcagccagcacaacttcgtctgcgtgccttaccttgagccgccctttgctgtcttttgtcatgacgccgatacatcgtccgtcctctataagcaaatctgctgccgtttcattctcgattaacttgattttgctgttgatccgtttgagcaaataatcgataagcagcctgcctgttgcgtctccgcctgcatgaaatatgcggttgtatgagtgggccccttctcttccaagacaaacaccgcctcgttcattgcggtcgaatggaaatccacgctccaataggctttgaactatcatttttccatcatgtaatacgtctgctgcaatagctagattattatggccgcaccctgcgtataacgtatcctccagatgggcttcaatcgagtcatcttttgcataggccgcagcaatcccgccttgtgcatagacagaattgctgtttttgacgcttttttttgtgataacagtcacttcgtatgagggcgggaaagctgcagctaaggaaagtgccgccgcccctgaaccgatgactgcaatcgtctttttagacatatgccatcctcctgttgtttacatctgtcttgacacctatatttacacaaggataaaataaactcaagagttttttatggagaacggatggaggaagaccggatgatttatttagattatgcagcgacaacgcctatttgtgaggaagcccttactgtatatcagaagcttagtatggatatgtacggaaatgccagcagcctgcatgatgcaggaggaaaagcaaagcacatactggagtactgccgtgaaaaaatcgccaacatcattggcggagaagcaagcggcatctattttacaagcggcggcactgaatccaattttctggccattcaatcattgctaaacggcctgccaaaaacgaaaagacattttattacgactgccatggagcatcagtccattcataattgcgctgcttttttggaacagcagggatatgatgtaacagtcattgaaccgaatgaatacgggcttattaccgaggaaatattactagcccatatccggccggaaacaggccttgtatctattcagcatgcaaattctgaaaccgggatcattcagcccattcaacgcctgtcttcatacctgcacaataaggggattcttcttcattgcgacgctgttcaaacgtttggaaagatcccgatcaatacaaaaaatctgggagtagatgcactttcaatgtccagccataaaatccacggtcctaaaggagtaggggcggtctatatccggccggatgtcccttggaaacccgtttatcctctgactactcacgaatacggattcagagccggcaccgtaaatgttcccgggatcggtgccttcactgccgctgcagaattgatcgtaagcgaaatggaaaaacagatatcccgcaatgaggcattaagaacatactttctagaccaaatccgtattcggtctctccctgtaacccttgcggcagacacttcgcaagcagaatgtcttccgcatattatagggtgtttttttcactcatttgaaggacaatatgttatgttagaatgtaatcggagtaatatttgcatttcaaccggcagcgcttgttctgcaggttaccacggtccgtctgaaacaatgaaagcattaagaaaaaccgaacaagaagctctgcaatttatccgcatctcttttggcaggcatacaacagctgaacagctggaacagttattacatacgtttacagtgctttgggaacaaaagaaaggagaatatgatattgaccgaagaattaaagctaatgggcgccaacaggcgtgaccagcttcttctgtggctgaaggaatctaaatcaccgctgacaggaggagaactcgcaaaaaaagcgaacgtttcaagacaggttattgtacaggatatatcgctcttgaaagcgaaaaatgtaccgattatcgccacaagccaaggatatgtatacatggatgcagccgctcagcagcaccagcaggcagaaagaatcatagcatgtctgcacggtcctgaacggacagaagaggaactgcagctcatcgtcgacgaaggcgttacagtaaaagacgtaaaaatcgagcatcccgtatatggagatttaactgcagccatccaagtaggcacccggaaggaagttatccatttcattaaaaaaatcaattctacaaatgctgcctacttatcacagctgaccgacggcgtgcacctgcatacacttacagcacctgatgaacatcgcatcgatcaagcttgcaaagccctcgaagaagccggcattttaattaaagactaaaaaaagccctctagagggcttttttataattggtaagactggtatgcacccaggagcttcactttgcagccgagcgcttcaagctcctgcatggctcctggaatcaatacatcatcaaacgctttctcaatatcaataataaagaaataatggcctaatccggttttagtcggacgtgactcaatttttgacaagtttaaatttctccaagaaaatgcagacagcactctatgcagcgccccggactgatcatcctgcggcagcatgaccattaaggtcgttttgggcctagaactcaattttgaatttacttcaaaagatatgttttcatcaggagacaggataacaaatcttgtatgattgtccctataatcctgtatatcccgtttcacaatttttaattcatatgtagaagctgccatatcattggcaatgaccccgatattcagctcgggatggtcactgacaaactttgctgccgccccggtagaattggcgtattcatatggaacggaaggaaaatgtcgatggagaaatttatggcattgcgcaatcgcgtgtgaatgcgagtaaattttgtcgagctctttccatgcattctctctagagggatggacgagcaagtgctgatgaatcggcaacgtcatttcacccacgattggcaagggctgttcatgtattaaatagtctattgttagattaacagatccttctaatgcattttccaaaggaacaaaagcaaaatcaacttcgcctgcaacggccgcatctatacactccggaatggtgcggtaagcaacatgttcggcgccgttttgaaaacaagaactgactgctagatgtgtaaatgtagctgctggacctaaataaccgactttcatgacgattttctctcccttatgcacctgaacctaatatttcaactttttctacaaaatcaaacttcctgagcttattcattaatgtatgaatgtcttcttccattgccgacgtactgatagacagtgtcacatttgctctgccttgaagcggaatggtctggtgaatggaaagaacgttgcttccagaatcagctaccgcctgaagaagctgagataacgcacctgacctatcctctaaatgaaagaaaagtgtgataatttgttcttttaccatggtgtagaatggaaaaacagcatccctgtatttataaaacgcacttctgcttaaatcgaccttttgaacggcatctgctactgaatctgctttttttcgatcaagcagctttttgacttccaatgtttttctcattgcatcgggcaatacatcttcacggacaagataaaatgtctcctctttcatttgcatcccccctttaaaatagagagcctgacaccaggctctcttttcagccaacattcattaatcaataaattcaaattcaaattccagaagcctgattatatctccatccttggctccgcgttctctgagtgcttcatcaacacccattccgcgcatctgtcttgcaaaccgtttaaccgattcatcacgtgagaaatcagtcatcttgaataaccgctcaaggctgtctcctgaaagcacaaatacaccgtctggatcgcgtgtaatgttaaatggcacttcttcattttccatcgtgtacatgacacggttttgtgtaagctcttcctcgtcatacagcgggaactccggtgtgttttcaagctgattggcgacttcaaacagaagctcacgcagaccttctcttgtcaccgcactgatcgggaataccggataatcatccgtcagcttttctttaaaggcttcgagattttccgcagcctccggcatgtccattttatttgcaacgataatttgcggacgctcagtgagacgcagattgtactcgctcagctcctggttaatcgtaagataatcctcatacggatcgcggccctctaagcccgacatgtcaatgacgtgaacaataaccctcgtccgttcaatatggcgcaaaaactggtggccaagtccgacgccttggtgtgcgccttcaatcagtcctggcaaatcagccatgacaaagctgcgtccgtcatccgtttcaaccatgccgagattcgggacaagcgttgtaaagtgatagtccgcaattttcggttttgcagatgagacaacagacagcaaagtagattttcccacactcgggaacccgacaagtccgacatctgcaagcacttttaattcaagaacaatgtagcgttcttttcccggctcgccgttttctgaaagctgaggcgcgggattagccggtgtagcaaagcggctatttcctcttccgcctcttccgcctcttgcaatgacagcccgctgtccgtgctctgttaaatcagcgatgacctgtttcgtatcatcgtctgtcacaacggtgcccggcggaactttaatgaccatatcatcagcatttcgtccgtgctggtttttggacatgccatgctcgccgcgaatcgctttaaagtgttttttgtatctaaaatccatcagggtgcggagaccttcatctacttcaaaaacgacgtctcctccctttcctccgtcaccgccggcagggccgcctttcggcacatatttttcacggcgaaacgcaaccataccgttgccaccgtcgccgccttttacatatactttgacctgatctacaaacataatgtcctccgttctaaaccgttaaaaactccgctagtccaaccctatttcaatcaaacattcgtgactcgtgatttcaaaacgcatgatgtcaatgtcctcatatccattctgccgaatatcatcaaaagcagatggatcggcaaaggcgccgtgaaaatcaaggtacagaatcagctgtctgtcaggatgatctgtttgaagcgaaaccgttaaatgattttcactctctctgctgactgcttgatcaaacagatgaaacagctttctcatcagtttcgccagcttttgatcataagccgacaaatccttaatttctccgagaacttcatattcaagcgtcatataatgggttttccaattaaacgtaagaaaatcaaacgccaaatgcggtgttttcaggtttgagagctttgattcgtgctttgcgtctataaccatttcttcaatcatttcaaagacgcggtcatacttctgcaagcttaagtttcctttaatcagctgcagcttattcatccaatcatgccgggaatggccaagcagatgaatcagttcgtttgttaatgccgtgtcgcttatattttcttcttgattttttgaaacatccttcattttcgcactcccaatcatttaatttcttatttaggagtctgtataagtgtgtattatgaattataacagagaaggctttgttagaaaaacaattgtttttcccagaaatatcatgttccttttttctggctttggttgatttgcagccaggcagaacattttatgtattactgcttggggaacatatccagtgggtttgagatgtttattctcattcttggcggggtctgctcgcacatactctgcatttcattctaggtgtttactccgcatattgcaaaaaaaactccagtcatcatcgaccggagttttttgaatcattattgagctacaggatatacgctcacttttttgcggtcacggccgaaacgttcgaatttaacagttccgtcgattttcgcaaatagagtgtcatctccgccgcggcccacgttttcacctgggtaaatttttgttccgcgttgacggtaaaggatagaaccgcctgttacgaattgaccgtcagcacgtttagcacctaaacgtttagcctcagagtcacgtccgttctttgtagaacctactccttttttagaagcgaaaaactgaagatctaatctaagcatgtagctcacctcctatattatgtttgtggtcacacgcaagttgtctttgtaatcccgttcgattgtctccagcgaaacaatcatgccttcaatcagcagctgagctttttggcgtgcctctggatcaagagattcagggaattcaaaataaaaataacccccgtcctcccctatatcaagaagcggctcgaagcccgcgagcacaatgaccgcgttaacggctccaaacacaacggctgtcactccggcacaaacaagatcttgtccatgttcagcaaaattcgcatggcccgacatttcaaaagacaatatgcctttatcatgagaccttctgattgttgcctgaatcatgcttacgcgttgattttttcgatcgtcactttagtgtaaggctgacgatgaccttgttttttatgaacgtttttctttggtttgtatctgaaaacagtgatttttttcgcgcggccttgtttttcaactttagccgttactgttgcgccttcaactgtagggttgccgactttcacgttgtctccgccaacaaacaaaacgtcttcaaaagtaactgtttcacctgcttcagcagcaagtttttcgatgtaaacagtttggccttcttcaactttgatttgtttaccgcctgttttaatgattgcgtacattctctgcacctcctattagactaagactcgccagataccagggggctgtaaaagctcttaacacctgtactgagcggttgtagcaatggtgctacatccataacattaaaaaatataccaaaatacaaggcgtttgtcaatcagttttagtagggcagaagcagttcctccatggaagaattcgtccgcttatcggcaaagtaagcgtgcagcacttcattctcgtcaagctggctaagcttttggcctgatttttctataataatcggatgcttacagccacgtttgaactcggccatcacatgatagactttatcctccgcctttactgtcagcggcagaagtttctcaagctccctgttttttccgtaatacctttcgaggagaaatctcacatgggtatagtgcctttgccgatattcctcaaataaggaaacagccagaaagacaaacaaaacccatgcgctgatttgcagaggaatcacgaataaaacccagcacccgagcaacaggcagaagcagagcgacgtttttagattaagccggtgagccttttgaaaaggcagctgtttggaaaacaacaaaaataacagttttcctccatccagcggccagatcggcagtaaattgacaaataagatagaaagattataaaaggtgaagagttcaaaggtatgctgatgaatcactgagacttctgcaagcatccaggcggcaaactgaagccagatgtgctgaagagggccggcaataatgaccgcaaactcttcctttaacggccgattcccgtgctcttccacttcgaccgttcccccaaacggcagcaaaaaaacacgcttgattctccaagaaaaaaacacagccagagcagcatgccccagctcatgaatcaatacaatcaggagcagacaaaataatgctttcatatggcctgtgagcaagcccagcgccgcgataatccaaagaaaaggatgcacatggatctttaagataaggtcgagccatttattcaaatgaaatcacctgaatcggatcaataaatttatcgccgtctttcatggcaaaataatagacccctttattatgatcatcaagcttaatcgaaccgagctttttgcctttatccacaaaatcatataaagcaacatccacatctttgagctcgccatagatactataggtgttgtcagcatgctgcaccttaaccgtcagtcccgtctggctgtctttgctgacttcaaccacatagccttcttttacactatcaatcttatcgctgcttgtttcgactttaattccttccccattgtcctgaaaatcctgctgtactttcccggatgcaggcgcgatcagatctttgcctacttcaatctgctgttccttatttttgtgttcaggagccaggaaagcaagcggatttccgaatttggtttcgaaccaatggcttgctgaggcaaattgaaattcagtttcaaaggttttggctacagcgggtttaatctgactgacgggtccaatgtttgttttataggctatagctgaaacgagaacaaggcaggccgacagaagacatttcaggataattgaatctgttttcaccaatgggtgttttccgttgaatgttggcatgttatcttcataaaccggaagtgttccatgtttttcctgatccgttaccatcacccaggacgggggtttctgcttttcagaaactgtctgagtagagaaacgttttgagccggaaagctgctttcttcttttctctaatcgttttctgatttcatctgctctgtgactcattgccatcatcctttgcattcgttgggtttgtacatcatatgtcttgtccatggcaaatattcggtttagtcaagaacaaagcaggcaaaaacaaaaaaacctgacacagcatatgctttgtcagattcttctctttgattctatcacattaagatcttactccgaaaaatgacttaatcttagccatcattcctttgttttgctcttcaagcacctgtaaaggaacagattcacctaagatgcggcgggcaatattgcgatatgcaatagaagcacggtttttagggtccatcgcaatcggttcgccatgattggaagctttaatgacttcatcatcatcagccacgattccgagtaaatcgatcgacagatgctgtacgatttcgtcgatatccatcgtgtcaccgtttttcatcaggtgatttctgattctgttaacaacgagccgcggcggttcaatattttcctcttgctccagcagtcctataatacggtcagcatcacgaacagctgagatttcaggcgtagtgaccacaatcgctttatcagctccggaaacggcatttttgtacccttgctcgattccggcaggacagtctatgatgacatagtcaaattcctgtttgagctcttggaccatgtttttaatttgttcaggagcaacagctgtcttatcgctcgtttgagcagcgggcattaaatagagcagatcatcgaaacgtttgtcttttacgagcgcctgatgcattttgcatctgccctctacaacgtctaccagatcgtaaataattctattttcaagacccattacaacatcaaggttgcgcagtcctatatcagtatctactaagcatacgcgcttccctaaaatggctaaggcggtaccgaggttcgcagatgttgttgtcttacctactccgccttttcccgaagttattacgatagcctcacccaattcacattcctccctcaagccttgttagatcaggtcttaaatgagccaaatgttgaaggcgttcaatgaccatatttccgtctgtatctaaataagcacattccatttcgttccctttttgaatgtggtctggggagcgatttaacacatgattgattcttaattgtgtcggaagcatttcagaggcggcgatgaccgcttgattatttccattaaatccagcatgcgcgattcccttcagtgagcccagaacaaaaatgttccctccggccttgactgttccgccgggattcacgtcaccgatcaggagcaagtcgccttttacctgcagcacttggcctgaacggacaatttttgaaacagaaataatttcggcttcctctcttatctgctgtgcttcttttttagtaatgacttcactgtcaatagaatgaacaaacaaatctttctttgacgcaatcaattcggttagctgttcctcttgctccttatataaaaagcgatttcccagcttaacatgaacgctgattttctggccttttccatcggtatattgttcaattgacagcatattctgaagaccatcgagaagctcatcaaaagaacacgcatcatccagatgcaatgttagtccattctttgttccttttattgttacatattgctgctttttggtcttcacaatattcacctcaacaacatactcatttcgtcaaaaaaagataaaatcctttttactcatctctcaattctttctttagactcataaaaaacaatctaaatggcagaacaagaataagagctgctgcaatatttaataaaattgtcggtataaaccggtcaagcacaaatccgttaaacgtcataatgtctttatgaatcaaagactgaatgccgaatacgtaaaattcgagcagacagacagccagaactgctatcaatatcactacaaatgcgtttgtatgcaacactttaaacgcttttgaagccaaatagcatagccctgcaaaaccaaacatgtaaacgcctaatagacttgtatagttcatgtcatatagaaaaccaaaaataaatccgtaaatcatcgcgtgtttttggttgataaaagccgacatgaatatcaatacaagcatcaaaaaacgcgggcgagcacttggtcatctgtaacgaaaggaaaatgcaccaaatctgtaaaaatgctttccgcagaaaaaacaagcatcataacgaaagggagaaggaaacgtttcacgatccttcctcctctgtatcgacagtcggcacgtcacggtttacaacgatcacattatttaaatctgtaaggtcagccgcaggttttacataagcaaccttcgtcagtccataggaatctgactcgatatcagtcacttcaccgattgtcagcccttctgggaaaacaccgcctgtccctgatgtttcaataagatcgccttttttcacgtcttgtttatccttacgctcaataattgtcatcttaagacgttttttctctttgtcatatccttcgatcaagccgtagcctttgctgcctttttttccggaaatttttgtcgcgactctgttattgcggtcagtatcgcttaaaagctgaacagtagacgtaaaattgttaagtccggagcttttgatcttgccgattaatgcgcctttttcgtttgtaacggccatatctttcgctacgttttgctgagtccccttgttaatggtgacctgtttggcccaattatcagggcttctggcgatgaccgttgctaaaatcggcttgtaatctttaatcgatttgacatggccaagctcgtcacgcaaggatttgttttcttcttcaagctcttgaagcttggcttcatattgtgtctgtccgtcaagtttttctcttagacgctcgttttctttgtatgtgttttttaaatcattgatgttctcaaatattcctgcaaaaaattcggcaggcgtatgaaaaatattttgaaatactcccgtcgtatcgccgatcactttctcaggccaggtggtattgcggccgcccttcagcgaaaatccaatcatagccaccaatatgataatacacagaagtaatagcattaaccgcttattcggcatcgtgttacacctcttctattgaactcccgattatctagttttccctttgaaaagatggatgtgctccagtgctttccctgttccgatcgctacacaatcaagcggatcttcggcgataaggaccggcatttttgtttcttcgctgatgactttgtccaaattgcgcaaaagcgctccgccgccggttaacactatacctctgtccatgatatctgctgcaagctcaggcggtgttttttcgagtgtgctcttcactgcttcgacaattgtagatacagtgtcgcgtagagcgttagaaatctcttttcctgtaatttcaattgttttcggcagacctgtgagcaaatcgcggccgcggatttccatgttgtcggattcttcaggagcttctgcagatccgatttccattttaatcgcttcagccgtacggtcaccgatcatcaggttgtacgtttttctgatgtagttgataattgcgtcgtccatctcatcaccggctacacggattgactgagacgttacgatgcctccgagggaaattatcgcaacttctgtcgtaccgccccgatatcaacaaccatgcttccagtcggttcccaaactggcagattggcccgattgctgcggcaaaaggctcttcaatcggatacgcatcacgcgctcccgcctgtcttgtcgcatcgataacagcgcgttcttcaacagctgtaatgcctgatgggacacataccattacatatggttttctggcaaacatgcctttattttttatggcttgattgatgtaatatttcatcatcgtcgccgttgtttcataatcagcgataacgccgtctttcatcgggcgaagagccaccacgttgcccggtgtccgtccaatcatatttttcgcatcatttccgacagcgacaatcgatttcgtatccgtctgcaaagcgacaactgacggctctctcacaacaattccttttccttttacaaaaacaagcgtattcgcagttccaagatctataccaaggtctctagcaccaattccaaacatatgtatgtatcttcctttcttaaagcaaaaataccctaaagggaaaaactcataaactctattatagcttaattcgacgaaaaaaaaagtgttacaaatatcctttttcctttaaactcacaaattttttatccccgatcaccaaatggtcaagcagctcgatgccaatcaggtttccgcattcaaacagccgtcttgtcacttcaatatcttccctgctcggcgtcggatctccagaaggatgattatgaacacagataaaggaagcggcagatcgtttaaacgcttctttaaacacctctcgcgggtggacaatagatgaattcaggcttccgataaatacggtgcgtttatgaatgacttgattttttgtatttaagtataaacagacaaaatgctcctgggttaaaaagcgcatatcctccatgacaagattagcgccgtcttccggggagcgaataacgaaatgttcttcgttggctaatttatgaatccggcttccaagctcaactgcagccagtatttgaatcgcttttaccataccgattcccgggatgcttgacagctcttcaaccgatgcttccttgagcaggcgcagcccgtcaaatgagcgcagcagcctgtttgacaggtccaaaacagattcgtgtttagtccctgtccgcaataatatagccaaaagttcatgattcgctaagttctcggctccgactttcaggagccgttctcttggcttttctttgattgggaaatctttgagttttaatggcagatcgtgtatgaccaagcactccttttctttcccttcccgtttatagaaccgtcatgcccttatatcaaaatggcgaagagctctcattgtttttgatataggaaggcccatgactgaataataatctccgtctattttctttacaaaaagcgcgcctcttccttggatgccgtatgcacctgctttatccatcggctcttttgtttcaatatacgtccaaatctcttcttcactgagggaccaaaacacaacttctgtcttatcataaaaagtctcgctgtgattttcagcttgaatgctgaccgcggttattactgagtgacttcggcctgaaagcctccgcagcatagaagcagcttcttcttgatcctgcggtttgccaagacattcgccgtcaaggcataccattgtatcagcaccgataacgattgcatgcgggtggagatcagctacagccttagctttttgttttgccaaccattggacgttttcttctggtgaaaagtttcgatttaatttttcttctacttcactgacaataatggagtagggcagctggagaagatcgaggagttctttcctgcgcggagattgtgatgcaagtattagcggttttgtcatgttcgtcatcctttcagggtttgcttaagaaaaaaagatactcgtttatcctaccaaatcacgaggcttgtcacaatttcagaaaaataactttttcatgacaaaataaaaaaagcctgtcactaaaggacgaaggctcagggcactatctcttattttacgacggctaacagctcctgctgagccttccacccggcttcagcacttggatcctctaattcctttaaagcctgcaaaatcgcttttttctctcctgtttctgacgcttttgtttcaccaagagacttttctattttctctacactcgcttttgtaatgtcttcgccgagaatcgcctttgctgcaagctccgctgtttccttaaaagaatctgtcatatctgactctattgataaggaaagctccttgcctccccaggcttcaaaatcactgtcgattaaaacctgtcctaactgctgtgagacatccttatcactggctaagcccgcgatgacatacgtatacccgtcatcctttgacagtgacacggcggaatatcctttttcggtcaattgttctgttaacgtttcggcacccttttcatttgaaaattttccggcttgtacagcgtatgttttatatgtaccttcagtttgcgccgcttgtttttctgtgcctgaagtttgtttatcagttgaagtatcccctgcttttgccgtttggctgcctagagaatcctctaaagaggccggtgctgacgcttctttattccccgatatgcttaacgcgaatagccctaatccagtgccaatgacagccgcgaaggcaatcgtcgcagccactctttttactggtttggcagtcccggtctttccttttgcataagactttgtttttttcttttgataaggaggaacaactttagggtcctctttaaacaccttgtcttcctctgaatcccaattgaattcatcttcatcaggatgttcctgggatgccgcaacctcttgttctgcctgtcttttttcctcccaatttgaaaatgtcatgcttttatccgcctctgtctcaggcgtctcttgttcgtaaaccgtctcttcttttccattaatcgtcaccttgagggctttttctgcggctttactgttttttttattctttctttttttcaattccgcttcctcccttcatttgcttgaccgttcttgtcggcttttcatgctacacactttagcacaggcaaagaaaaaaagaacaagacttttgtcgccttgtccaaaaaacgttcgtcaaatttttcagcagtcagcccaatgccattttgatataaaaagaaatgatagagtcaccgtataaataggctaaaatgctccctgcggctatagcgggggcaaagggaagcggctgccttttagcgagtctaccagtcagaacggctgccgctccatataatgcacctatcaaaacagaaaagaaaaaggcagctgccagcattttcacaccaagcacaaagccaatcaccgcaaataatttaatatctcctccccctactcccccatgggtgattgcggcaattacagccagaaatagaaatccggctgccgcacctaacaggcctgcataccaggaatcaagcggagaaatcaatctcgcggccgccaaaaagggaagaaagaaaatcaatatacgatttggaatcagcataaaatgaatatctgtcactgcaacaataatgagaagagagataaacaccacagcgggaaacagttccagcgacgtgccaaagcgtattcctgcggcggcaaataaacacgctgtcacaagctctgctgcgggatacataaaagaaatcctatgcccgcagcttttacatttacctttttgaaataggaatgacaggatgggaattaattctgcaggagttaatgtcctccggcaaaacgggcatgatgaacggggcgcaataatagatagatgtaaggggatacggcacccggccgtatagtaaaaagaaccaaggataagcccgaagataaaaagaagtgatagcatagacaacacacctttacacactgagttctggtatggattgtagcaaaatgagcatcctgagctccaattggagatattcaattttacacataaaaaaaccggcagaatcttttttttgattctgccggagccggatacttttatttcaacctttttcgaatgtcagaaataaagtaaagagatccggtaatcagcacaatttcatttgagccctttttactttctatgaatttgatcacatcgtctggatcttcactccagcttttattgctgatttcacttgcatcatagagatcttttgcaagagaagcacgcgggaaatcaaaagaagcaaaatgaatcgcatgagcaatggtttccagtcttttaatcatgttctgatacggtttgtcctttaacgcgctaaacaccacagaaatgcgtgaattggcgaaacgctgcttcatcgtttccgccagcttttcaacaccttcttcgttatgcgcaccgtctaaatataccggaggatgttcctgaacaagctctaaccgtcccggccaagcagccttcacaagcccgctccttaacgcttcgtcactgatatgggcgatattctccttattgagccactccgcagccaaaatggacaaagcagcattttgtctttgatgggtgccaatcagagatgtccgaatatcttcatagcatttctcttccgttttgaatgaaaactgttctcctgcaggcagagcctcttcattgaaaataacacatgcatcatgcaatgactggaacggcgcagcatgccgttgagcttcatggcggatgacctgtaaagcttccggctgggtaactgctgtaacgattggaataccttctttaataataccggccttttctcctgcaatttcttcaatggtgtttcccaaaatattcatatgatcgtgtccaatgcttgtaatcacagttaagagcggttcaaccacattagtagaatcgaatctaccgcccaaacctgtttcaaaaataacaaaatcgaccttatgaaattctgcaaaatataaaaatgcacaggccgtcataatttcaaattctgtcggctgtccgtattccgtttgatcaagggcttcaacgtgcggtttcatttgattgacgagtgctgtccattcctcatctgaaatcggtatcccgtttacgctgatccgttcattaaacgtaataatataaggcgatgtaaatgttccaaccgtatatccggcttcctgcagcatagaacggataaaagcgacagttgatcctttaccgtttgttcctgcgacgtggaacgctcggatttttttttcaggatgtcctaaccgcgccatcagctgtttcattcggccaagtccgggcttcaccccgaatttcagcctcccgtgaatccagctgcgcgcatcttgatatgcagtaaacaatgataatcccctcttttataagacaaggcggtttctctagaaaccgccccggcttttcattaacccttcagctcagccattcgtttttgaacagcgtcacgcttcgccacataatctttttctttttcacgttcttcatcaattacgtgtgcaggcgcttttttcataaatccttcatttccaagtttcttttggacacgctcaacttcttttgtcagtttatcaaattctttttgcagacgggcaatttcttcatcaatattgattaagccttcaagcggaagaataacctctgctcctgagacaacggccgtcatcgccttatcaacagcctcaatatcggtgccgattttaagcacgctcggattcgtaaagcgttcaacatatgaacggttcgcttcgaggcgggctgctatttcgtctgtgcttgttttaatgtacagttcaacctgcttgctcattggcgtattgacttcactgcggatattgcgcacagaacggattagctcaacaagaagcttcatgtcagctgccgcttcagtatcggtatgctccggcactactacaggccattgacttactgtaatcgattccccttggtgaggaaggtgctgccaaatttcctccgttaagaatggcataaacggatggagcagacgcatcgtttgatcaagtacgtaagcaaggatggaacgggtagttttcttggcagcttcgtcttctccataaagcggtagcttcgccatttcaatataccaatcacagaaatcatcccaaataaagttatataaatggcgtcctacttcaccaaattcatatcggtcagcaagctgggtcacgtgctcgatcgtttcatttaatcgcgttaaaatccacttgtcagcgactgacttttcgcctgacagatcaagctcatcgtacgtcatgccatccatattcattaatgcaaaacgggaggcgttccaaattttattggcaaaattccaggtcgattccactttttcatagctgaagcgcagatcctggccaggagagcttccagtcgcaaggaaataacgcagagaatcggctccgtacttgtcaatcacatccatcgggtcgacaccgttgccaagagatttactcattttccggccttgctcgtcacggattaagccgtggattaaaacatctttgaacgggcgctcgcctgtaaattcaatgccttggaaaatcatgcgtgatacccagaagaaaatgatatcgtaccctgtcacgagaacatctgtcggatagtagcgtttaaagtcttcagccgttacatcaggccagcccattgtggagaaaggccatagcgcagaactgaaccatgtatccagtacgtctgtatcctgttcccaattttcgctgtcttccggcgcttcaagcccgacatatagctcgcctgtttctttatgataccaggcaggaatacgatggccccaccacaattgacgggagatacaccagtcgcggatgttttccatccagtgtaaatacgttttttcgaaacggtcaggcacaaagttgaccttttcttctttcttttgcagctcaatcgctgcatcagcaagcggctgcatgcgcacaaaccattgtgtagaaagataaggctccacaacagctccgcttcgttcactatggccgacagagtgcatatgatcctcgatcttgaagagaactcccgcctcctgtaaatctttcacgagctttttgcggcattcaaaacgatccataccttgatattggagcgcattttcattcatcgtgccatcttcattcatgacaaggatgcgttctaaattgtggcggttgccaagctcgaagtcgttcggatcatgagcaggtgtaattttcacggcacctgaaccaaattccatatcaacatagtcatcaccgacaatcggaatttcacgatttacaatcggcagaatcaccgtttttccgataaggtgtttatagcgctcgtcttcagggtgaacggcaacagctgtatcaccgagcattgtttcaggacgtgtcgtcgcaatttcaattgagcctgaaccgtcagcaagcggatagctcatatgatagaacgcgccttgaacatccttgtaaatcacctcaatgtcggatagggctgtttttgtcgctgggtcccagttaataatatattcgcctctgtagatcaggcctttttcataaagcttaacgaatacttctcttaccgctttgctcaagccttcatccagcgtaaaacgttcacgggaataatctaggccaagacctaatttcgcccactggctgcgaataaagtcagcatattcttccttccacttccacgtttcttcgaggaatttttcacggcctaaatcgtagcgggatttgccttcttcacgaagtttcgcctccactttagcctgtgttgcgatgccggcatggtccatgcctggaagccacagcacatcatagccctgcatgcgtttcattcttgttacaatgtcttgcagcgttgtgtcccatgcgtggccaaggtgaagtcttcctgttacgtttggcggcgggatgacaacagagtatggctcttttgtctggtcactgcccgcttcaaaaaatttgccttttagccaaaaatcatatcggtctttttcaaccgctgccggatcatatttcgtcggcattgtttgttcattcgtttccatcataaccctccagcatgtttaaaaatggctgagaacgaaaaaagagctcttcatccctgtaaaaggacgaaaagctctttcgcggtaccaccttttttcatgaactctatcagttcatgcacttataacggataacgggtgtttcccgaatttctctactcttctttcaagaaattatgctcccgggcgaccttccaatcagacaacataagaagcctttcagcaaacggcttctctctctgcatgcgccttttttgtactcttcccgttctaagcaggtgtatttatcagctcattgtatacattatttatgttctttattatagtaaaagtgtttttgattcgtcaatcatcttttccaaaaacaccgctttctatacagatgggcaggcacctattgcccaagtttacatatgatgcttgtaaatgcgtagaggaggatgcaccgtgaagaaacgtttcagctcttattcgctgccgccatgggtaaggcaaattcggcttgtatccgcacaagtgattattcccattacgatttttcaaggaatcagaaccattttctttccgacaacctttgatgttttgctgctcgcaatcctaatctttttagcttgcgcccttcatttagaatggatataaacaaacaagtccgcgccattaagacgtggactcgttttcagcctgaaattttttctcttgttcaatctgatgaattttcatcacaaacggctctatgtttttcatttgccaataagcctttaataattgtgtacattcctctttttcatgctgtcttttcccagtttgataaccgttcagcaccttgtacatggctgccggatatgccatatagctgagaaaaagactgacttccgcttcacgcaaagggaatgatttcgtatatccataaaaccattcgacgcattccggacaagctttcggaaagcctctgaacatttttgtataaaagccgagcaggtcgttttgcggcggaccgacagatgctctttcgaagtttgtaaaatatccggtcccggcatcattatacagaaaatggtgtatagacaggctgccgtggttcattacaacccttgaaacgtccttttcctttgccgactcataccagtcctccagccgttccagcgcaaaattcaccgcggaaatggtttctgaaaaataggttatggcctggagttcaaaaggagaaaggtaccattccttctccgctctatccacaaactgctcatagaaaattttatcttgttcccacttttttttcgtttgcccgtaataacgttcaatctcatcacgtctaacctttagttcctgcgcggttctctcgtgaagacgggctgtttctctaaataaataagcatgtttctgatcccgttcttcctcttggtcaaattggagccaaggcattaaatagtaggtatctccgtattgtatgcctgctgagaaaaactcaccgctatttgttctgtaaacgggaacgaatgaacgaaagcctttttcctcaatcgccaccatatgatctgtaaaatgcttgccgcgaccctctttcaattttttcagggcaaatacaccgtagtctgtatacactttccaaacaagaggactgacaggctcaataaattgagcagtcagtccgtattcccgaagaaccgattgggtatcttccatttcattcaccacattttccgatcgcttacggtttacgcatggctatttttatattgaggaatatagagaatctgtcctgcttttaattcatcatccaaggctaaagaattcatcctgatcagctgctgggatgtaatttcataccgttcgcataaacgctcgatcgtatcttcctgctgcacaatgcatattttcattctcgaaaactcatccgcttcttttgtaaagagttttgttaaataaagagaattatcactttcctttgtttgaggttccttcgtttcagcagcaggagcaaccctaggaacagcatccgtttccttcctttcagtctcagaagtttcaggcagctggaaggattgaaaaggtgtttcttccttaggctcttcagctgatggtgtttttctcacttcaatttcgaagctctcttcctcttgttcttcctcctccagcagcttaggcgctgaataaaaagaatcctcctcttcttgttcaggcaggaaggtacggtatgccggttcaggcaattcttcttgagatgcctcctccgagcttgttttttggttgaaatggaaatgtaaatcggcattgtcattctccatatatacagctgaagctgtttctctgctatcttctatggagagagcggcctctgatacactctccaaagcttcatccggttccgcctcttcttggcaaagcgcaggatcagcctgatccgattgagccgcttcttccttttgagcctcttggcgcagcgcatattcatgattaggagacactgttgtttccgctttttcctctgcaatcacagtctctgaatgaagctcagcttccaaagcaggcgattcttctgcttcagcgtgttcacgaagctcagtctctgctggagagtctgcttcttcacgaacatccgctattgcagctgccggctctgccgtttctttttttgctttaacgatctcttgaatctctatttctgaaggatcaggttctggctcagattcttctgtttccgattcagcacgaacctccgtttccggcacagcaagctcttctgactcttcttcctctttcacatcttctctggcctctggttctgaagcaaccgattcaggcggctcagattctgctttttctgtctccagttcttcacggagccccgctttcgagataaaaagttctggcggttcggctggcggttcatgctgaagaactgcttcctctgccgatgatgcacccggttcttctactacactatgtgccggcggctctgaaagctcttcctccctgaatgccgcaggagcttcatataaaggtatctccggctctttgtcttgcgtatcatccaaaagtccttcaatcgctaaatcagcttgaattgttaaaatgcgcgaatccgtcaattgatagtcaaatgcgtcaataaagacgaagacatcctgtaaatggctcactttatttttcggaatggtaatatccacaggaaaacagtgagtcagttccgcacttccatcctctctctttctgacttgttcaacaaaccgcttatctgtataaatctcttcggtatgtttgttttgatctatgttgtactcacctgtaagttcaagcgatcctatgattgatacataatcatttacttcctgaaccctaatatcaggatctaatgaaatagaaagcagttcagaaacttcctgtcctttttggaaacagatcgattcttctacagaaaattgcaatcgatgattttgcggcaagttcatatcctcctttcatctaatccttaaaattagatgtcactaaaggtgtatgtatgaactggagaaaatatgagtgggagagcacgaaaaaaccggcacaaggagtccttgataccggttttcactcttatctgcggctgatctcagcaaatactttctcagctgcctggattgtgttttcaatatcttcatcagtatgggccgttgagaggaaaagaccttcgaattgtgatggcggaaggaataccccttcatttgccatccctttataatagcttgcgaacagcttcaaatcagatgatttcgctgtttcataattaatgactggttcgtttgtaaagaagaaaccgatcatcgaacctgcacggttaaaggtatgcggaatgccatgaacctcggcggcttttgaaattccttcttccagtctgtcgccttttttgatgaaattcttgtaggaatcaggtgtcagctgtttcaatgtctctaagccagccgtcatcgcaagcgggttgcctgacaatgtaccagcttgatagatcggaccgcttggagcgatctgctccatgatttctgcctttccgccataagcgccgacaggaagtccgcccccgattacttttcctaaacaagtcagatcaggcgttacgccgaagtaaccttgagcgcagttataatcaacccggaagcctgtcatcacttcatcaaaaatcagcagggagccgtactgctcagtgatatcacgcagaccctgcaggaagccttcttgcggcggaacaacacccatatttccggcaactggctctacaatgactcccgcaatgtcttcaccgaattgctggaaagcaagctttacactttctaaatcattgtacggaacggtgatggtgtttttcgcaatgccttcaggcacccccggctgtcaggcagaccgagagtggcaacacctgaaccagctttaatcaagagagaatcgccgtgtccgtggtagcagccctcaaattttaaaatcttgttgcggcctgtatagccccttgccaaacggagggcactcattgtagcctctgttccggagcttaccattcgtacaatttctacagatggcacacgatcaatgacgagcttagccagttcattttctacttcagtcggagcaccgaagcttgtcccgtattcagccacttttttgaggctttctacgacgcggtcatttgtatgccctaaaattaaaggcccccatgacaagacgtagtcaatatattcattcccgtcaatatcaaagattttcgagccttttccacgctccataaaaatcgggtccatgtctaccgatttaaatgcgcgaacgggactgttcacaccgcctggcatgagtttttgcgcttctttaaaagccgtttttgatttttcatagcttctcatctgcctcaactcctgtcaactgaataaaattactccgcaagccatttcgctgcgtctttcgcatgatacgtaataatcaggtcggcacccgcgcgcttcatgcttgtcaaaatttccaacacaatttctttttctttgatccagccgttctgcgctgcagccttcaccattgaatactctccgcttacattataagcgacgagcggcaaagtaaactcattttttacgtcacgcatgatatccatataagaaagcgaaggtttgacaatcaaaaagtctgcgccttcttcgacatctgattgtgcttcgcggagtgcctccatacggttggcagggtccatctgatatgttttgcggtctccgaattgcggtgtgctgtttgctgcatcacggaacggaccgtaaaactcacttgaatatttcacagcgtaagacatgattggaatattgacgaatccttctttatcaagcgcttctctgatcactgtaacaaatccgtccatcatgtttgatggcgcaatgatatccgcacctgctttcgcttggctgacagctgtctgcgctaaaagctccagcgattcatcattgaggatgaccccgtctttgacaagtccgcaatggccgtggtctgtatattcgcacaggcacgtgtcagcgacaacaaccatttcagggaagtgttctttaatttctgtgatggctttttggacaattccgtgatcatggtacgcttgtgttccgcaatcatctttttcttccgggatgccgaacacgataacagattgaatgcccagtttgaccagctccgctacttcatccttcaataaatctaatgatacatggtaaacatcaggcattgacggaacagcttttttgccttccagaccttcaacgacaaaaatcggataaataaaatctgatgggtgcaaacgtgtttcctttaccatttctctcattgcttttgatgtccgcaggcggcggtgtctattaaatgattgactcatattctctcttcctctcttgacatgctgcacattaactcaagcatgccatctattgtaaatgtatcaggcatatgcgatgtgatgccgtatgtcagaagggcatcatttgttaaaggcccaatgctgatacaggccgtcccattcgccttccacttttttaattcttctcccaagacatgcataaacgtatgtacggttgatgaactcgtaaatgttacatagtcaaaggaatattgacccgcagcgtctttcagtgcctcaatgccttcttcatccggaatcgtttcgtagagaacccattcctttacttcaaaaccgagcgggacaagctcttgttttatcacatcacgtgacaaattccctttcatcacggtaatgggctcccccggttcagcatgctgcttaagagcgtcagccaattgttcagcaatatactcctgtggcatcacatcaaccgatacgttatgcatttttaaacggcgcgcggttttttcaccgacggctgcaatttttttatgcgcagggagaataagctgattttccttcagataagaaaaaaagaagtctgccccgttcacacttgtaaaaacaagccagcctggcgcggcaagatcctctcttacctgttccgcaacatcattcggcaaagcgcggcgaaacgtaatcaaagaggttaaaaccgctttaccgccaagcgcctccactttttgctgaaatgatgctgcctgtgccttattccgggtgacaagcactgtttttcctttcaacggaaaatcattttccatcctcgtcaagctcccgttttacacgatcaattaaatcttttgctcctttgtcagccataagagcggcacagcgctttcctacttcctccggatcgtttccggtgacggtttctttaaaaatgattttgccgtcaggtgaagcgacaagccctgtcatttcaatttcatcctgtccatttaacacggagtagcccgcgatcggaacctggcagccgccctccatcgcgtttaaaaaagcacgttccgctaagacagtccgttttgtatattcatctgtaaactgagaaaacaacgccaacagctcttcatccgattctcggcactcaatcgccagggctccctgccccacagcaggcaaacagcgctcaggctcaaggaattcggttacgacatcttgcttccaacccattctggaaaggccggcagccgctaaaataatcgcgtcataatcctctgtttccagcttttgaagtcttgtatctatattacctctaatccatttaattgtaaggtcagggcgctcaatcaaaagctgcgcgcttcttcttaaactgcttgtgccaatgacagcaccttccttcatttctgaaagctttacgcgattctttgaaataagggcatcacgcgggtcttcccgttcaggaatacagccgatcacaaggccttcaggcaaaacagcaggcatgtccttcatgctgtgcactgccatatcaatctcttcgtttaaaagcgcctgttcaatttctttgacaaacagcccttttccacccacttttgagagtgtaacatcgacaatccggtcgccctttgtcacgatctttttaatttcaaaagcaaacgaaggattgatttccttcagtttttgaataacccattttgtttgagtcatagcgagtttgctccgtctggaacctactttaatcgttctcatcatttctttcctcccgaatctgcttgggacatcgtttaactgaaccaatggaattgcgacaggcttccaagcaggaaataattgatcatcagcaccagaaaacaagccgtattccacagtgctgcgacctttccttgcagctctttaatcagcctgatataaagataatagctgtacagcagcaggacgacaaacgaaccaagcactttggcgtcaaaccaatacagcgtttctagtgagacatacgcccaaatgacgccgagaatcaaactcagcagcagcatcggaaccccaatgacatttaaaacatacgccatataatcaagcttagataaatcttctattctcaacagccattttccccactttttctttttcagcagatgatattgaaacatatatagcacagaaaaaacgaaagaaagggaaaaagcgccatatgaaagaatcgccattgtaatatgaatcaccaaaagctcagatacaagctgcccggaaaaagcagctgactgctgctctgtcggtgaaaatgtgtgaatggcgatcatagaaaatcctataacatttgtaaaaaacacgataaagtcaacacgtaaaagctttgtcagtacaagtgacagcgtgacaagcacccaggcataaaaataaagcgcctctgtcacatttaataccggaaaccgccccgtcacccacataaaataggccaaatacacggtttgcagagtccagacaatagaaagcaaccagaaggccatttttccagccttccggttgtgttgaagaaaatctataaaataaaagagtacacttaaagcgtaaatgacgattgtcccctcattaagtcttgccattgcagtatcaatcattcagctttcactcacttacaagtgggctaaagcccgcttttgattcagccttcttaaaagagtggaccttctggctgctttcaacggttttcatcatttgacggcccgcagcttcttcaatatcaaaaatctgcataaacaacgcgagcttttcttcagaatcagcatctgccgcaagctctttcacctttaaaatcggatcacgaagcatttggttaataatacttttggtgtgtttgttcaacagttttttctctcttgtgcttaagtgaggcagcttacgctcaatgctgtccatcgtttctgactggatggcaagcgccttttcgcgcaatgcagaaataaccggcacaacaccaagtgtattcatccattgtttaaattccacaatggtttcttcaattaacagttcaactttttcagctgtttctctccgctctttcatgttcgcttctacaatgccttccagatcgtcgatatcataaagaaaaacaccttcaagatcattcagcgccggatcaagatctctaggcacggcaatgtcgaccataaacagcggacgtcccttgcgaagcttattcgcgttttccatcatctctttggacacgacaaattcacttgcaccggttgaactgattaaaatatcagcctccgcaagcgcgctttcaagctgattcaagcttctcgcttcacctgagaaacggtctgcaagctccttcgctttcaagtatgttcggttaatgacagtgaccttgccgattccctgtccgtgcaggttttccgcagcaagctcgcccatttttcccgcaccgagaatcaatatgtgcttgcttgaaagatttccgaagatttttttggcaagttcaactgcagcatagcttactgacaccgcatttgagccaatgtctgtttcggcgtgagtccgcttgcccactgtaaccgcctgcttaaacagctcattaaaaatagtcccgatcgttttttcttgctgagctgttttaaagctgtcgcgtacctgtccgagaatctgcgtttcgccaatcaccatagagtcaagtccgcaggctacacggaataaatgctcaacagcggcatcgctctcataaaacgttaagaacggtgacagctcttctttgcttaattgaaaccaatcagctaaaaacttttttatataataacggccggtatggagctggtcgactaccgcataaatttcagtgcggttgcaggttgagacaatgatgttttcaagaatgcttttctcttctttcagctgcaccattgcttctgccagctcattcggctgaaaacttactttttcacgtatctcaataggggcggatttataatctactcccacaacaagtatatgcatcgctctaattacacccccaacacccaatctcaatttataatcattctaacatagaactcattatttataacaattataacatagtttctttcacaaaatgtgaacagattttaaaattcttatgctatattagaaaaagcttcagggaaaagaagcattcctattgacaataccaaaaacagcagaaatttactacacatcagctctaaaaaacaagaaggtgatatgcatgaaacaaaaatcaattttattcccttgtctgctgcttgccgcttctgtatatgcatggctagaaagcggtcaagccgaactgttttcagggcaggatcaatggcctgttctcctcatgctgttaggcgcagcctttgtatatcaaggaaaaaaagaagccgttacaccccatttttttattggtttacttctcttcgggatcggtttacacttttttgccaagccgaaatgggtatggtggccggatgattttgaaatgctcctctttatgatcggcttctcacttctcgtttcaaccgttcaaaaaaaagaatatgtatatgaagctgtgtcgatgatttgtttttccctgtttttgtactttttcaaacaaattatggcatggcttgagtctgcgcatattccaacagcgcttctgaaggagtattggccgtttgtctttattggaatcagtttattgttattattgataaaacgaaaaaaatctatacgataaataaaaccggtagaggatcctctaccggtttatcatttttttgatcgctccccaagcttcgtcttttccctttttcgtttctgaggaaaagagaatgagctcgtcttccggatcaatatttaatgtttgtcggacaaccttcgcgtgtttgtcccatttgcctttcgggatcttatccgcctttgtagcgataacaataacaggaatgccgtaatactttaaaaattcatacatctgtacatcatcattagatggcgcatgccgcaaatcaacgatctgcaccacagcttttaattcctcgcgtgtcgtgatataggtttcaatcattctgccccatgcttcacgctcagactttgacactttggcaaaaccgtagcccggcacatccacaaaatgcagctcatcattgataatgtagaaattaagcgtttgtgtttttcccggctttgatgacgttctcgcaagatttttgcgattgattaatgaattgataaaagacgattttcctacgttcgatcttccggccaatgcgatttccggaagcccccctcagggtactgttccggttttactgcactgatcacgatttctgactttgtgactttcatttcttctctcctactaaggcatgttccaaaacctcgtctaagtgggacgccaatataaatgtcagcccctccctgacgctttccggaatatcctctatatctttttcattatctttaggcgcaataatggtcgttaatcccgctctatgtgcgccaagcgctttttcctttaagccgccgatcggcagcacgcgcccgcgaagcgtaatttccccagtcatgccgacttcacgcgaaaccgcccgtcccgttaaagcagaaacaagcgctgttgccatcgtaataccggctgacggaccatcttttggcaccgcaccctctggtacatgtatatgaatatcatacttctcatgaaagtcaggttcaatgccaagttcttctgttttggatcgtacatagctgaatgcagcctgagctgactctctcataacatctccgagctttcctgtcaggattaatttccctttccccggagaaagcgatacttcaatcgacagcgtatctccgccaacggttgtataagcaagccctgtcactacaccaacctgatcctctgtttcagcttgtccatatctgaaaatacgttttccgataaagtcttgaaggttcttctcagtaaccgtaatccgttttcgctcttcagcaacaatggcttttgcagctttacggcaaatcgcggcaagctggcgttcaaggcttctcacaccagcttctctcgtatagtagcggatgatatcaagaatcgcctgatcacgcagctgcaggttgcttttcttcagcccgtgttctttgatctgctttggaagcaagtgatcctttacgatttcaagtttttctatttctgtgtagcctgcgatattaataatttccattctgtctctgagcgggcccgggattgtggccaaattgttcgccgttgcgataaacagcactttggataaatcaaaggtttcttcaatatagtgatcactgaagctgctgttttgctctggatcaagcacttcaagcatagcggaagacgggtctcctctaaaatcagatgacattttgtcaatttcgtctaataagaagaccggattcagcttgcccgcttttttcatcccttgaataatccgtccaggcattgctccgacataggtccgtctgtgtccgcgtatctctgattcgtcccgtactcctccgagtgagattctgacgaatttgcgtcccaagctttttgcaattgatttggctaaagacgtttttccgacacctggaggtcctgccaaacagagaatcgggcctttcagggatttggtcagcttctggacagccaaatattctaaaatacgttcttttactttttcaagcccgtgatgctcttcgtccaagagacgtcctgcttctttcaaatcaagcttatcatctgtttcatccgtccacggaagagcaaccagccagtcgatatagttgcggatcacggagctttccgcagaacttgacggaattttttcatatctgttcaattctttaagcgctgtttccttcacatgatcaggcattcctgcttcttcgattttttccgtcagggtgtgaacttcgccagttttgccttctttatcgccaagctctttttggatcgccttcatttgttcacgcaagtagtattccttctgcgtacgctccatcgaacgtttgacgcgctggccgatttttttctcaatctccagcacttctttttcattattaataaaatcaatgaccttgttcagcctgtctttgacatcagccgtttctaaaatatcctgcttatcctttagtttaaggggcagatgagaagcaacgatgtctgccattctccccggctcttcgatatcagtaaccgcggcgtacgtttcggccgagatttttttagaaatttttatgtactgatcaaagtggtctagcaaagtccgcatcaatgcttcgtcttctgtatcttttgaatcatcttcatgaataagttgaatgtcgaccgacgtgtaatcctcgtgttcattgtatttgacgatctgggcgcgctttaagccctccaccaacacacgaatcgtaccgttcggaagcttcagcatttgcttaatttttgtataggtgccgacagtgaaaatctcgtcttcaccaggttcgtctatcgaaatatcctgctgagtggctaaaaatatcatatgatcatgcatcattgcctgttcaagagcctgaaccgacttgtcacgtcctacatctaaatgcaaaaccatcgtcgggtacactaataaacctcttaaagggaggagcggaatgctgcgttttaattcttctgccatgtgactgacacctccgtgactttagtatgaaccattataatacaactttttcatccttgtacaataaacggcatggttccattttctataaaacagtctcctcgtagtataccctttctttctgatatgaaaaaggaaaagatgtccttcatgaaaaaaaccctattatcaaaatagggtttaaacggattctttattgatttcaatatgaaacggtttttgttccgttggcggattcactaaaatttcatcaagcacttcctggaacgtctttactgcaataatctcgatcccgtcaatctgctttaagatcgcctgctgattttcatatgggataatcacctttttcgcaccggactgcttggccgcttttattttcggaatgacgcctccgatgggtttcacaagaccgttcaggctgatttcgcccgtcatcgcaacggtattgtcaataggaattttgtgtatcgccgagaaaattcccgccgccatcgcaatgcctgctgacggcccatcaatcggaatccctcctgggaaattgatgtgaatatcataatcagaaggcttcattcccattgtccggagcacggttaatacattttcaaccgaacccttcgccatgctttttcgtctgattgattttgattggctgccgatgctttcttcttcagctattcctgttatgttaattgatcctttatcttgagccgcggttacacttacttcgatttccagaagcgatccgctgttaggcccatagactgcaagcccatttacaatgccaacctgtggttcaacaccgattttttgctcgtgctttggagtaagctgactggagtgaatgacccattcgatatcctcaatcgtaatgtccttccgattctccgttacagccatccccgctgcgatttgaatcatattgacggcttcccgcccgttccgcgtgtagctggtcaaaagatctaggccttcttcggagatatttttttcaattttatccgctgctgttttggcaaccgttttcagctcgtccttttcaagctcgcggaaaaaaacctctaaacagcgggacctgatagctggcggaatttcgtttggcattctcgtggtcgcgccaatcaagcgaaaatcagccggcagcccattttgaaaaatatcatgaatatgattcggaatttgtgtattttcctcactgtaatacgcactgtctaaaaagacttttctgtcctcaagcaccttcagcattttattcatttgaataggatgcagctcccctatttcatcaataaacagcacaccgccatgggcatgggtgacagctccctgcttcggctgcggaatcccagcctgtcccatcgctccggccccttggtatatcgggtcatggacagagccgatgagcggatcggcaattcctctttcatcaaaacgggctgttgtcgcatcgagttccacaaaaacagcctgctctttaaacggtgattgtttatgtttttttgcttcttccaacacaagccgcgcagcagccgttttcccaactcccggtggcccatagacaatcacatgctgtggatttggcccgcataaagccgcctttaatgctttaatgccgtcttcctgtccgacgatatctttaaagcttttggggcggaccttctcagataatggctcggacaagctgatagcgcgcattttccgaagctgctccatttccttctttgattctttatctatcgtgaccttttgtgtcctttgatttttaagcaaattccaaaaatacaaaccgatgatgatcccaaaaaacagctgaataaataacgcgatccctgtccaactcatggtggtccctcctgaaaaacaatttatgtatccaattcattcctctgattgctagtatctcccatagaagacgggaataaacgtttttccggaagagttgcatgcaaaaaaacctcctgagtgttaccactcaggaggttcgtgcttatctttatgcagatgttttatcttggcttacctcagtgccgtctttcaataagaggcgaggaggctctccgtgtgtcacagttgccccggtaattacacatttttcaatgtcatcacgagaaggcagctcaaacatcacatcaagcatgatgccttcaatgatggaacggagtccgcgtgctccagtcttgcgttcaattgcttttttagcaatttcagaaagcgcttcttcttcaaactcaagctcaacgttgtcaagctcaagcattttcttgaattgcttaactagagcgtttttcggttttgttaagatcgcaaccaatgcttcttcgtcaagcttttcaaggcttgcaataaccggaagacgtccgataaattcaggaattaacccgaaacggagcaaatcttcaggaagcacttttgaaagaagatcttctttctcaagatcagcagctttattgtcggcaccgaatccaatcactttttggcctaaacggcgtttgatgatttgttcgataccatcgaaagctccgccgcaaatgaacaaaatatttgttgtgtcaatttgaatgaattcttgatgaggatgcttacgtccaccttgaggcggcacgcttgccactgtaccctcaagaattttaagcaatgcctgctgtacaccctcacctgacacatcacgtgtgatagacgggttttcagattttctagccactttatcaatttcatcaatatagataatgcctttttcggctttttccacatcataatcagcagcttggatgagcttcaagagaatattctctacatcttcacccacgtatccagcttcagtcaaagatgtagcgtccgcaatcgcaaacggcacatttaaaatgcgagccaatgtttgcgccagaagggttttaccgcttcccgtagggccgattaatgaaatattactttttgaaagctcaacatcatcaactttgctgttagagttaatgcgcttatagtggttatacacagcaacagcaagtgatttcttcgcttgatcttggccgatgacatattcattcaaaatttcgcgaatttcctgaggctttggtacgtctttaaattctacttcttcttctgttccgagttcttcctctacaatttcagtgcagagttcgatacattcgtcacatatatatacaccaggtccagctacaagcttacgaacctgatcttgtgtttttccacagaacgagcattttaattgtcctttttcctcgttaaatttaaacattctttcaccccttaatcttgtctcactttttcttttaccggcagagcaaaagaaaatgattcttgaaacgaacgagtatgtattgcattttaccatactttccaaaaagacggtaacaatgtgtttctgacttgcacattctatatgtatgacaaaaaacagccctgcattaactatattgccccaagaaaaagagataactcataattgtacaaaacaaggcacgaatgattcgcgccctgttttattagtactattattatgcaccatattaacggttttctacaagaaaatcaattgctttgcgaacttttaaatcttctttcatcgcgtcagtagaaccgatggcttgtttaatattttcaacaggcatgttgtatgcttcagccatttttgtaagctcagcatcaacttcctcatctgatacttcaaggttttccgctttcgcaatcgcctcaagagtcaggttagattttacgcgtttttcagcatcttctttcatttgctctttaagcgcagcttcatcttggcctgagaattgagtgtaaagctcaaggttcatgccttgcatttgcagacgctgttcgaattctttcagcatgcggtcaagctcagtgtcgaccattgcttgcggaacatcgatttcagcattttcagaagctttcagaacaagctcttcacgcaatttagcgtcagcttcgttttcttttgcttcttctaaacgtttctttgttttttcagttaattcagcaagtgtttccacttcttcatcgatatcttttgcgaattcatcgtcaagctcaggaagctctttcgctttgatttcgtgaattttcactttaaacacagctggtttgcctgcaagctcttcagcgtggtactcctcagggaatgtcacttcaacatccttctcagcgcctgcttcaaggccaactaattgatcttcgaagccagggatgaatgaaccagaacctacttctagagagtagttttcagcttttccgccttcgaaagcttcgccgtcaacgaatccttcgaaatcaagaacaactgtgtttccttcttcaacggcgccttcttctttaacaacaagctcagcttgacgctcttgaagggcttttagttcgttttgaacatcttcgtcagttacagctgtgtcgtctttttcaatgcccaggcctttgtattcgccaagcttcacttcaggttttactgttactttcgcagtgaagattaagctttcgcctttttcgattttttcaacatcgatttcaggacggtctacaggctcgattccagcttcttcaaccgctttagggtattctacaggaagaagaatatccaaagcatcttggtaaagagcttctacgccaaagcgctgttcgaataatccgcgaggaattttacctttacggaatccaggaattgaaacttgttttactacttttttaaatgcatcatcaagtgctgttttaaacgtttcagcatcaacttcaaccgttaaaacgccttcattgccttcttgtttttcccattttacagacatgtgtttccctccaaaaatctattcaggttgtgtcggtcttccattctaaagcaatcattcggcttcgtccaacaaaaacaaagctgccaaagatcagaatcattatgtatagatgttaataatgaactgcaaagcctgtccaaccgtatttcttataacccgttatacacaaatacaaccactatattataacataacacatagcgctttcaactatatggcgcgatttacaaataagaaatttcttcaatatcttttaacattgtgcaagcttcatcgagttctctgtctgtaaattcatacatcatatgaagttcttctctttcaatttcaattccgtgcatctcgtaaccgactttatgcagggcagccgcccaaaggtcagccgacagcaatttcggctggaacggatataaaacgtacaaatgtcttctccacaattcttctactgccgcatataaggttggattttcatttccaagtgtctcatccagcaccctgagaacacggtgcagaatcggggcggcatcaggcggaacaatctcagacggttcaattgtcaacgactcgccaaatttgctaatgtgtacaggtttactgtactcatgctcagctaacagcatgacaatcatcgttttgataatcggatgggctgaggggtcttggaggattgttttgagcaatcctgtatactttgctacgttacggtcttttaaggaatggatgagattcatttgctcctcagggcttgccagcactttctcggtgtcaattgtatcctcatattcttcggcccaagcctcgtcctcacgatctggatcggtcattttccggctgaaatccagcagcttataaaattgctcggcgctttctgccggcagctgattttcttccaaaacggcttcaatggtgcttttgacttcttcgtactttttgagctgaattaagatggtcatgtacacctgcaaaaccgtaaaataatggccataaccttctttgagcatcttctcgcacacgctttctgccttttccagctcgcccagctctaaaaagcagatggccatccctaagtgaagatcggattcagtatcatcatatttcatcgcttctgaaaacagttcaagcgcttcttgatactttttttccttgagtgatgacatccctttttccacaaggcggtctttcagatgaggaaaaggaataatttttgcgtttttcttgtcatgcgtcatacctatattcctttcaggcatttattttgttcaagtgtatcaacacctgtgaacaaaaacaagaaatgaaaggtttcaccaggcaaaaaaagccgccggacaaataccggccgctttttcaggcttgaagccaagagcttctttgtgattcaaattgcttgatttcatcttccagcagcagcgttaatgaaatttcatcatatccgttgatcagcatctctttccaatgcggatcaacttcaaatgaaatttgattgccttcactgtcatgaatcagctgcttttcaaggtcaacagtcatttgcaatgactggttttcatactggccgacaagctgtttccaattgtcatatggcatgcggatcggaagcatgccgtttttaaagcagttctgatggaaaatatcagcgaatgacggcgcaatgataattttaaacccataatcatcaagtgcccacggagcgtgttcacgcgatgacccgcagccgaagttttctcctgctattaaaatggaagctccttgataaacaggctggtttaattcaaattcagggttcggttcaccattcgcatcatatctccaatcaaagaatgcaaaacgcccgtagcctgttctttcaatcctcttcaaaaattgcttaggaataatctggtctgtatccacattgatccgatttaatacggctgctttccccgtatgtgatttcaaaggttccatctcgcgcactccttacacaactgttttttcctgataaaactttctgacatcaacgaagtgtccgtgaatggcagccatcgcagccattgccgggctgacgagatgtgttcttgcaccttttccttgtctgccctcgaagttgcggttagaggttgatgcacagcgctctccctcaggaacaacatcattattcatactcaaacacatgctgcagcctgactctctccattcaaatccagcttccaagaaaatctggtcaagcccttctttttcagcctgaagcttcacgctttgggatccgggcacgacgatggcccttacgctgtcagctaccttcttccctttgatcatgtcagcagcctgtcgaaggtcagtcatgcgggaatttgtgcaggaaccgataaatacgtgctccactttaatgtcttcaattttctgatgaggagtcagtcccatatattcataagcgcgaatcgcttcttttttatcatcttctgcagaaaagctttccggcgcaggaacttcagaatcgacaggaagaaccattcccgggttaatgccccatgtcaccataggggaaattttgttgccgtcaaggacgatagatttatcgtaaacagcgcccgggtctgtgcgcagcgccttccattcctctacggccttgtcaaattcttcgccttttggcgtgtacttgcgatttttgcaatattcaaacgtcacctcgtcaggtgcaatcaaacctgctcttgctcctgcttcaattgacatgttacaaacagtcattcgttcatccatcgtcatatttctgaatacttccccagtgtactcaatgacgtagcctgtgccgaatttcacaccgtatttgccgatgacagcaaggatgacatcctttgccgttacccctttttgaagcgttccatccacgcgcacttcaagtgtttttggacgttgctgccaaagtgtctgtgtggaaaggacatgttcaacttcactcgtcccgattccaaatgcaagagcgccgaaagcgccatgtgttgatgtatgactgtcaccgcacacaatcgttttccctggaagcgttaagcccagttcagggccgacgacatggacaatcccttgatccacactgtgaagatcggcaaggcgcacgccaaattcctcacagtttctttcaagcgccgttacttggcgtttcgcaacttcatcctttatctcaaaacgattgacagtcgggatgttgtggtccattgtcgcaaatgtgttttggggtcttctgacctttcttcccttttgtctcaaaccttcaaatgcctgaggagacgtcacctcatgaatgaggtgcaaatcaatatagagaagatccggctttccctcaccatgttttacaatatgctgatcccaaatcttttcgatgattgttcgaggcatcatcttttatttcctccctctacctagagctaagaccgcttaacgtaagctgtcacacattagaaattgtattttcactcatgattgccgccttaacttcctctgtaatggcctgagtgccgctgaactcttcaccccgtgccaagtctcttgttctttttccggaagccaagactttgtttaccgcatcttctacagctttcgcttcctcttcaagcccgaaagaagttctcaaaagcattgccgctgacaatatggctgcgaacggatttgccatccctttaccggcaatatcaggcgcggagccatgaacaggttcaaacagatgaagaccagagcttgataggctggctgacgggagcattccgagcgagcctgtaagcatggacgcttcatcgcttaagatatcaccgaacatattttcagtcaccacgacatcaaattgattcggtgcataaattagctgcatggccgcgttatccacaagcatgtgctcaagcttcacatcaggaaactcttgtgcaacgtcctcagccacttcacgccacagccggcttgattcaagaacattcgctttatctacagaggtcactttgccttttctggctgccgccattttgaagccctctctgatcactcgttcaatttccgttcgcttataaaacagtgtatctactgcttcctgctcacctttagtgtttacatagcgtttgctcggctggccgaaatacaagccgcctgtgagctcacgaacgataacgaaatcaacattatctatatattcttttttcaaaggcgaagcgtcagaaaggctttcaaataccttcacaggccgcaaattcgcaaacaaatcaagctgttttctgatgctgagcagccctttttccggtctcagttccgaaggattttgatcccatttcggtccgccgacagcgccaagcaatatcgcgtctgcatttttacaagcagcaacggtttcctccgggagggggttatgatgttcatcaatagccgcccctccaatcaggccatattcaaattcaaattcatggttaaagcgttcggcaacacttttcagtacgtctgtcgctgattctaatacttcagggccgatcccgtctccgggcaatagagcaatacgtttcttcaagttaaccgttctcctttcttttatgatccgacagctgtgtgatttttcaacccgctcatattcgactggaaaaccaattgacggtttactgcgttcaaataggctttcgctgatgcttctaatacgtcttgcgctatgccccgccctgccgattcttttccgttcaccaaaactcttacatacacctgggcaaatgcatcttcgccttttctgttagactgaatgcggtagtctaagagctccacgtccttatcgatgcagcgctcaagcgtattgtagattgcttccacgcttccagctccagttgcagcttcctgaataagctctgcgttttcttgatttttcaaagaaagagtagccgtagggacctgacttgttccgtaatgtacttgcagagaaagaaattcatacccaatcttgcgatctgttactttttcttctaaaataagagaaacaagatcctcatcagtgatttcttttttcttctcagtcaactctttgaacatcataaagaatttattaatctcttcactgtcaaattggaatcctaaagcagtcagccggtctttaaatgcgtggcgtccggaatgtttacctaggacaagcgcatctgcggttacgccgacaagctccggtgaaataatttcataagtcgatttttcctttaaaaagccgtcctgatggatgcctgattcatgagcaaatgcattatctccaacaaccgctttgttgcgcgggacagccatgcctgtcagtttgcttactaaatcacttgttctcttaatctcgttcagagtaatacctgtttcgacttggtagaaatcttttctggtatggagggctacggcaatttcctctagtgccgcatttccggctctttcaccgatcccgttcacagcgcattcgatttgatcagcgccattttcaatcgcagcaagagagtttgcgactgccattcccaaatcatcatgacagtgggctgaaagctttgctttgtgaatgttcggaacgttttccttcatatatttaaagatatttccgtattccgccggggccaggtagccgacagtgtccggaagattgataacactggcgcctgcgtcaatcactttttcgacgatttctgctagaaacggcagttcagtgcggcaggcatcttccgctgaccattgcacaatcggaaaacgttcttttgcgtatgtcaccatttcaaccgctctttcaatgacttgctcacgtgtcattttcagcttgtgcttcaaatgaatgtccgatgtggcgataaaaacatgaattctcgggtgagaaccttcttttaacgcttcccaagcagcatcaatatcaccttttacacaacgggccagaccagttactgaacaatttttaatggttcttgcgatttcctgaacagctaaaaagtcacctcgggacgaagcgggaaatcccgcttcaatgatatctgccccgagtctttcgagctgcttagctatggcaagtttctcctgtgtatttaagttcactccaggggactgttcaccatcacgaagcgtcgtatcgaaaaaattaattttgcgcaacggagaccaccgcttccttcttcttgccttgtttcacaaacggcatcatttcacgaagctttcttcccactacttcgatttgatgttcgttctcgcttgcattgatagcgttgaaacgaggacggtttacttggttttcgacgatccactcttttgcgaatgttccgttttggatatcttttaatacttctttcatagattcttttactttagcgtccacaacgcgagggcctgatacgaaatctccccactgtgctgtgtcagagattgaatatctcattcctgcaagtccttcttcgtacataaggtctacgattaatttcagctcatgaaggcactcgaagtatgcaagttcaggctgataacctgcttcagttaatgtttcaaatccggctttgacaagcgcgcttaatccgccgcaaagaactgcttgctcaccgaacaaatctgtttctgtttcttctttaaatgtcgtttctaatacgcccgctcttgcgccgccgattcctttagcataagcgagggctttgtctcttgcttctccagtcacatcttgatagattgcgaacaatgcaggtacgccagctccttgctcatatgttcttcttaccaagtgtcccgggcctttaggggccactaagaatacatctacatccgccggaggaacaatttgatggaaatgcacgttaaatccatgagcgaatactaatgattttcctgctgtcaattcatctttgatttcagcttcgtagactttttgctgctgctcatccggaagcagaaccatgatgatttcggcttgggctgccgcttcttttactgaaaatactttatgtccgtcttcttgggcttgagtgaaagattttccttgtctaacaccgacgatcacgtctactccgctttctttaaggttcagagcatgtgcgtggccttgcgaaccgtacccgataaccgctactgtttttccagccaatacgttctctttgatatcaccgttataatatacttttaccatttcaatctctcccttgttatgttttatacaatagatattgttttattggatgacgccttttgctgggtacccctcgcaaaagccgttgtacctgttctcgcgatttctttaatgccataaggtttcaataactcaataagcgcttcaattttgttagattcacctgtcacctgaacaacgatgctgtctctgctgacatcaacgacagaggctctaaacggttctatgattccattaatctctgttctcgttgaaggcgcggagacaaccttgattaaggccagctccctctggacaatcgattgatttgtgatgtctgtgactttcagcacatcaatctgtttgttgagctgtttcgttaactgttcaacatcattttctccttcaacgtgaacgacgaaggtgattctggaaacgccggctgtttctgtgtgtccaactgtaatgctttcaatgttgtaatgcctttttgtgaatagaccggtgatccggtttaacactccggagcggttcaccacagtcaatgtgataattcttttcaaggtttcacccccaccatttcatgcagccctttccccggagccaccatcgggaatactttttcttcgctggcaacccgcacgtcaatgacaacaggttctcttgatgttaatgcctcttccagctttacctttgcttccgcttctgatgaaattctgatgcctttaatgccgtatgcttcggacaatttaacgaagtcaggctgagaagcgaatttagattctgaataacgttcttcatagaaaatttcctgccactgtctgaccattccgagacaagcgttatttaaaatcactaccttgaccggaagatttaattcgcgaataacatcgagttcttgaagcgtcatttggaaaccgccgtctccgacaaccgcgacaacagtagcatctttttcggccagctgtgcgccgatcgccgccggaagaccgaatcccatcgttccaagtccgcctgacgtgacccatttatctgctttttggaacggataaaattgcgctgaccacatttgatgctggcctacatccgttgcgacaatggcctctccttttgtaaattgatgaatatattcaatcaatttctgaggtttaaaaccttcttcttcattatctacataccagagcggatactcttctttccattcggcgagctgttttttccattcgcttgaatcgctttgtttgccgtcttgtttgatcagctcctgcaggacaattttgctgtctccgactacaggaatctgtgttttcatgattttaccgatttcagctggatcaatatcgatgtgagcaatctttgcgtttctggcaaagtgtttcaggtttcctgtgacacggtcatcaaaacgggcgccgatactgattaatagatcacattcatgaagggccatattggctgtataagtaccgtgcatccccgccatccccaggaaaagcggatggtcagccgggaagcctccgagtcccaaaagggtgtgtgccacagggatttgctgctgttcagcataattttttaattcttctgacgcttttccgtgcagtacgcccgcacccgccaggatcaccggttttttcgcactgctcacggcttccacaagcttgcggatctgcaaataattcggctctgttgtcggctggtatcccgggagattcatctcatgatcgtagctgaattctccttcaattgttgctacatctttcggaatatcaatcaatacaggtccgggtcttccagttgttgcaatatggaacgcttctttaatgatgcgcggcagatcttccggctggcgaacctggtagctgtgttttgttactggcatcgtaatccctaaaatgtccgcttcctgaaatgcatcgctcccgattacagaggttgctacctgccctgtaaagacgactaacggcaatgaatcaatcatggcatcagcaaggcctgtaacaaggtttgtcgctcccggtcctgacgtggcaatgacgacacccggttttccggagactcttgcgtatccctccgctgcatgaattgcgccttgttcgtgacggggaaggatatgtaccaaccctgaattgtatagcttatcgtaaatcggaagcacagccccgcccggataaccgaagatcatttctactttctctttttttaatgattcaatcagcattaatgctccgctcatcgtctgtgtacatttggcagatgctgaatccacctgtacattagtccccattttagttcctccttttggattttcatcctctaaagatcaatcttttattagctttatagctgattattcaataaaaaaagcctttccgcccacaatcagccgcgcagtatatgcgatagctaaaaggggcgaaaaggcttttctttccgcggtaccacccttgtttacggcctgttaatcggccgtctcatggatatttctatccgctttagtaacgagtgaatcaagttcacccggccaagtcctactgtcatttcagactggcactctgaggcgagttcaccttgtaaagcttcgccggttctcagctaacccggttctctgtggaaagctttttcaaggctacttatcctcatctgcgcttttcatattcagccttcggaacggctttccagctgttcaagaaggtcgtttgtttttcatttttttagaatcatattgcgatgattttcgcttgtgaagcttgcgtttatcttttgttgaactcatattacgccgctttggacgcagtgtcaacagcattttttaaaattattagacaattttgattaatcaatctatattgtatacgctttcattattggtacaaaaggaattgcaaatgttaaaagtttttataatttttttattaatctatcaagaatacaccagaattatttaattttatataaacatgtaagattttataacacgctatggttcgtatatggattgagtctgacagatcatcttgcaatccatttcaatttcggataggcacccctattattccccggcatacattaatggtatcttgcaaagaaaaggtgatacgatgaataaatcattagcagacatgcaaggattccctgcaggctttccgagcttcccgagctttccgcagcagtactatcctgctgtcccttccttttaccagcaaagccatcagccatttggaggctacggatacggacagccgttcagccaggcatatagcccgttaaccactccctctgctatgtactcctcttatccatacacttcagattttttcgggcagcaattttcaggcactggcttcagcggccatagcggcgggttcagtattccggcgacacatgtcggcggttttagcggaacagccggtgtgcatggaggctttagatattaaagaaaactgcaagggccgaacacgatttcggcctcttttttgctttcaagcatcttttgaagctcatacattccaaaaaggcttcaatactgtcagattatctgtctttatagttggaaacaggatcgaatatgattaagatgaatgtttgaggaggaataaaatgtatataaaactagatgatttaaccggtcatcaggtggtttcactggtgaatgagcatttacatagcatgacgcttatgtccccgccggaaagcatccatgccttaggtttagagaaactaagagggcctggaataacattttggagtgcatgggagggtgatgaactagccggttgcggagcgctaaaagaactggacagccggcacggagaaatcaaatcaatgcgaacatctgcatcacatttaagaaaaggcgttgccaaacaaattctccagcatatcattgaagaagctggaaagcgaggctatgagcggttaagcttagaaacgggttcaatggcttcatttgagccggcaagaaagttgtatgaaagcttcgattttcagtactgtgaaccgtttgcagactatgttgaagatccaaacagtgtgtttatgacgaaggaattgtgagacggctttataaggatagataagtacagaggaaggtctgtctatctcttaccgttttcccttctaaaatttaatagagtaagtcaacaaaaaccatccagcattgcattggatggtttttgggtggtttatttatatttatttacttcgtacatcaagatgtttttaaacacaacataatcctttttactctcaaaaggccctttgttgttgtcatgctcatctatttcataaaagcctggtccctctccggcatcacgctgcttgtaccatttgaggaatccgttcacttctttcatagacagctgatattctttttgcaaaccgtttaccatggtgacaacaagaagggcgtctccgtcttctgctgagttatcctcagaagggttgttgatcctttgtccttatctcctgaattgccttcagaaggggttgttgatcctttatccttatctcccggagtttcctctgaatcggatggtatgtttaaatcttttaacgaaatagatataactgatttaattttagcatttgcatatccaccaacaaaacttgatgtctcctcccttccaccgatgacgtaaagcgtatcatcaataatggcagaagaatgcgccattctgtatagtgctttcggatttgtcactgctgtagctgattgacttttaggatcgtacaccttaattcggtttacacctccagtcatcagaatttttcctttgtaagcaagcgcagaataataccctgctgtgaatccggtaccattttttacccacgtatctttttctggatcataaacataaacgatttggggaatataatgcgttccgccaagtaaatatagtttattatcaatcactgctgtagaagctccagttacttcataattttttaatgtctgttttttctcccatttcttcgtttctagatcataactgtaagtggttccatcaaacctattttcgaagcctaccacgtaaattttctttcctataacttcagcgtatatttgataggctggaacctttctttcaaaaggaagatcatctaatttttcccacatgtctttttttggatcatatacttctattgtgttgacagctccatcgtttgacattccgcccaagacataaattttcccatctacagtaactgatgcagctcccccctcgccgtgggcatgtcggcttttcttgtccattcatttgttttaggatcatagacaaacgtttgattcccataagtaccaggttttacagttcctccacctatcacatatatctttccatctactacaccgctgcttgcaccgacacgcggctcaggcaaatctgctctttctttccattcaactgtttccgcgctaactgtttggagcgattgaaacagcgtaataacgaataagaaaaaaacaacgaaccattttttcaaaagaaaacactcctttatttaattgtttcacataacaaatatcggcatgactatgaattttttcatatcttttcctgtatattcatttttcaggaaattccaattaaagttttctctaaaaaactcggatgttttcaattttgtttaattcaaagaacagcgggaattacaaaccacatgaacgatatcatgcaaattcataaaggaggagattgatatgaaaagcatagttggtgtatacgataccccgcaggaaaccatcgcagcgattgaaggcttactcacaaaaggctatgattctgatgacatttctgttgtgacaagccggcgagatacagattatttggagtcacgtacaggaacagaagtcaatcaagctatcgatgcacatcaggacgaatctgaatcttttttcgataaactgaaagattatttcacaatggatgatactgctacacacagcaaagcattatccgatttggatattaaaactgatgaaatagacaagtatcaagaagatttggatgacggaaaacttctggtagccgtcgatacagatgcagatgtaaatgctcctattgataacggcaatgccctttcaggcggcttttcaagcacaaatgaaatggcggattatacaacgaaagaagaaaaaacgatgccgctccgagaagaacagctgaaagtcgataaggaagacgttcaaaccggcgaagtagaaataggaaaagaagtgaaaacagaaaaaagagatatggacatcccggtgagacatgatgaaatttatgtcgaacgtcgtccagtggatgaaaataaaacggacgctgctcccgtcaacgattcggaagagatcagagttccaatcgttgaggaaaagctggaagtgactaaaaaaccggttgtcactgatgaagtggttgtcggcaaacgcactgttgaagaaaatgaacatatttctgaaactgtgaaaaaagaagaacctcgtctgaataaagaaggaaaagttgacggcttggatgatgatccgttaaataacaaatgaaaatcatagaccgacaacaaaaaacctcaaatccaattaggatttgaggtttttcttttggtacgtcccaggagagattcgaactcccgaccgacggcttagaaggccgttgctctatccagctgagctactgggacacgttttgttttttgtttttcgctttaactatcagcgacaagatttattatatatgggatgcaataataagtcaacggttttttagaatttttttcatgaggaagaaaattttcttcctcatgacattttcatagtgtgactcgattttgcagatcctcaatttcattgcctgcttggtcgtaaaaacggactgacgcagcatcattttctaatgtcagtatagcatagctttctgtcctgcgcaccctcggaagccggatgctgcctgggttaatcatcagttttccgcgcagcacttcgctgcccgcgatgtgcgaatgcccgaagcagataacatccgctccgagctcctctgcacgatagtatacgcttaacaaggtctgttttataccgtgaaggtggccgtgtgtgaccagtatttttcttgagccggcagtcagaagaagctcgtccttaaaatcgccggcaaaatcgcaattgccttttacaaccgcataaggctccaatgcaggatgcctcgtttcaagctcagagtccccgcaatgaatcatgagatcaacttctgcctcatgccgtttcgcaatggtttggagttcttcttcaagcccatggctgtcactgataatcagcacgttcatgtacaagcttcctccttatgcctccaaaagcttagacagctttttaagcgcgtcagccctatggctgattttatttttttcatcacttgtcagttcagccattgtcttatctttatctttcacgataaaaattgggtcatagccaaagccatattctcctctcggttcttcagcaatatacccttcaacatggccttcgactgtttttgtttcctctccgggaatactcacggccagtgcgcagcggaaacgggcggtgcgctgttctttttcgatacctttcagctcgctgagcactttttcgatatttgcctggtcgtctttctgttcccctgcatagcgggctgaataaaccccggtctgccgccaagattatcgatggatagaccggagtcgtccgcaattaccattttgttcactgctttggcaacagcttccgctttcagaatggcattttcttcaaatgtatggcctgtttcttcaatttcttctgtgaatccaatttcagctaaagatttgacatcatagcctcttggctcaagaatttctttgaattccttcacttttcccggattatgtgttgcaataattgcttctttcatgatgatcaagcctttctgtctttatttcagttctggcagagaatcacccagcacttctttttgcttgtcaatcagctcttgaattcctttttctgcaagacccagaagaccgttcagatcctctcttgaaaaagtcgcctcttccccggttccctgcagttccacaaaacggccgctgcctgtcatgatgacattcatgtcaacttcagcggaggaatcttcttcataatttaaatctaacaaaattccctgttccttatcaattccaacagagattgcagcaagaaaatcagtgatcggatttgtcttgattgttcctgctttgatcagcttgccaatcgcaatcgccatagcaagaaatgcgcctgtgatggaagctgttctagttcctccatcagcttgaatgacatcacagtcaatccaaatcgtccgttcaccgagcttttccagatctacaacagctcgaagcgcgcggccgatcaggcgttggatctccattgttctgccggaaattttccccttagaagattctctgattgttctttggtttgttgcccgcggcagcatgctgtactctgctgtaatccagcctttccctccgccccgcaaaaacggcggtacgcggtcctcaacagacgcgttgcagattacctttgtattccctgctgttattagaacagaaccttccggatggctgataaaatccaaatcgaatgtgattggacgcagctcatcgtgttgtcttccgtcatgtctcatgttttacctccgattgtatgtacataaaccatttttgtcccggaattgaataaagaaagaggcagccggaacgctaacctctttctttctagtatatcaaaaatcccaatttaaaaactacccgtattcacttgagatggtctggagaccggttctgtgagcttttcgcctttttcatttaccagctctgattttccgttcactttaacagacacgccttttatatccggctgctccgttaacgtgagcacaatgctgttcagcacttctgaagaaatcattttcgtcttctcatcggcgctgccgaatatagattgattgaaatccaacgtcacgcgcccgtctttgattttcggtttgctgaccagctttacatcttcactgaagtctgttaacagcccgctcaccttgcttggccctttagccaattcattgatggctgccgtgatgtcgtctttttccgaattgtcgattcgtttggtcaccggcacgtagtattcactgtcttcgttttccgccaagtagtagactgtcagcggatgggtagcagtgagatcatttacaccggctgtttccaaattaatgccgtctttgcggcttaaatcatctgagatcggcgtccctcctacaggcatctccttcagttcatgcccgtttattctcagcttcactttatctatcgaactaaattgcgtcagcgtccacgtcacagactgaacgattttctgttcgtcttctttcttataatttttgaactcattagagaaatcagctatcgcggttccatcttttttgatgtcaacgttaacggtggtgtcagccggcaatacagctctgaagccattcggaagaatttcagacacaggcccgccctgtacaaggtattcaagcgcctgcttagccgtgctctcacttttagggagaggcagcgtttgcgcaacaacatacccgtttttatcaatgagataaagctccctcatgacagtagatgaggcttgatctgcttttgcggtatcgcttttttcactttctgtttttttggctgctgttgtatttgaattggcacccgcttcatcgttcacgaatgtaacgtcttgaggcggatcaatttcctcggctgccttatcagattgaaacaaaccgcatccggataaaagcaaggcagaggtgagacaagtggcaccaatgactgcaggtccttttttcagcatacttttccctcctaaggatgtttgtactattatgtatacgagcctctttaggaaatagaccgaagaattccggcaaaacagaaaaaaacccgcaacataccgttgcggggaaaactatcttctaatcggttcttgcagtgagatgcattccacatggcccacctcatggccaaaccaatcgtctgcgattttcgcaaactgatcacgcgctcctgttgtcaagaactgatgatcaggggcattcgcagactggttcagcagccctttatacgagagaatcgtgctgacttcccgggctgtttcatcgccggacgaaataatgttcacgtgttctcccatatatctttgaatggcttctttcaaaatgggatagtgggtgcagcctaaaatcagcgaatcaatcgatgtatcttttaacggatacagcgaggttttgacaatctcgtctgctgttttgtcgagaaacttcccgctttccacaaaaggcacaagcagcgggcaggcaaggttttcaaccttcagatcagggtttaatgccaaaagcgcctcttcgtatgcattgctcttaatcgtattctctgtgccgatgacaccgatatgctgattatccgtcacttttatcgctgctctcgcaccaggctggatcactccgaccaccggtataccgacgcttcgctggatgtcatccaatgcgatcgctgttgctgtattacaggcgatcaccagcattttgatgtggtggttttcgagtaaataattcgtcagctcccacgtatattgaagcacctcttcttcagggcgcggcccataaggacaccgtttcgtatccccgacgtagataatattttctttaggtagctgtctcatgatttccttcgcaacggttaaaccgccaaccccggaatcaatgactcctattggttgttccaacaaaatcgcctcattttctcttcatttcatgctgcagtttcatcaaagatttttcgaagatggctatttcttcatctgtaaacgattcgaacatatcacgcagatattcctgtctttttgtaatgacctcttggataatccgttctccttcaggcagcagatgtatccggacaacacgtctgtccgccgggtccttgacccgctcaacaagctcatttttttgcatgcggtcgattaagtccgttgtcgtgctgcatgccagatacattttgcccgataattcaccgattgtcatatctcctaattcataaagccattgcaagccgacaaattgcggcggcgtaatcgcatattgattaaggatttctcgtcctttttgcttaatgatcgcggcaatgtggcggagtgacttttcaatatccgcaacatgctccaaaggttttgatgtcatttgtccatccctcactcaaggatctcttacgcacaaaagcgttccgtgtctattttccttcttttttgaagaaaatgcaagactcgcaggagagaaatagaggactttagtcaaacaacatcaagaaataaaatttattttatgacttgcctacgttttgcaaagcattccaaaaatgatttcgaatgtttcaaacaaacagcaataaccggctccttcctaaaagaaggaataccggcaaggattaaagctctagctcacccattctaagaagctcaacaacggcttgcgaacgccctttcacacccaatttctgcatggcatttgaaatatggtttcgaacggttttctcactgataaatagctcgcttgcaatctcctttgttgtcttatcttgaacgagcaattcgaacacttctctttctcttttcgttagcagcggcttcgattgaaattctttctccttcaagtattgtaaccctccttgctaaggtgagagcgaatcagaaacgaatgggttttgatatagtcgagatatcatatgtaagaagggcacaggaggtgacgtttacaagataattagtttatcgtgtatgaagaagcgtttctttctcctcatccgtccagctgacagccttgccgctatcctttgagacttgaaccatcacgactgccccggtgaagcagggctcgccttcgcggttctctccgagatagtgcaaggtaagagatgaactgccgactgcgcttgttttcacatagatgcgcaactcttcataaggcatgacttggcgcaaataatcgcattgctggcttgccacgactgtcatggtctgtttgttttcactcatcatattcagctttttaaaataagaaatccgcgcctcctcaaaatatataaaaggggttacattattcatatgcccaaacatgtctgtctcggaaaatcttacggatacctcattgaaaaaagaaaaggatgttttccattcttgaaacggcatatcaatataagcgggaagcttcatcttctttcatctccttattgtttaaaaaaacctctcccatgcggaagaggttttttcttcttatactctgtcgcttccgaagaaattgcggaacgcttgtaagtttgtatctctattcaaggctgcaatcgaagtggtaagcggaatccccttcggacaggattgaacacagttttgcgagttgccgcaatctgcaaggccgccttcatccattaatgcttctaatcgttcagatttattcatggcgcctgtcggatgtgcgttaaacaggcggacttgcgacatcggtgcaggccccatgaacttcgatttgctgttcacattcgggcaagcttcgaggcagacgccgcatgtcatgcattttgataattcatatgcccattgacggcgtttttccggcattctcggccccggtcctaaatcgtacgtaccgtcaatcggtatccatgctttaacttttttcaatgaatcaaacattctgctgcgatcaacctgcaaatcacgaacgactgggaatgttttcattggttttaaacggatcggctgttcaagctggtcgataagcgccgtacaagactggcggggttttccgtttatgaccattgaacatgcgccgcatacttcctcaagacagttcatatcccatgtgacaggggttgtcttctcacctttgacattaaccggattccggcggatttccatcagagcggaaatgacgttcagattcgggcggtatggaatctcaaattcttcatcgtaaggcgtgctgtcggctgtatcttgacgtgtgataataaatcgtatggttttttgttcactcatattatttcgccaccttcttcttcgagtaatcccgtttccgaggcgttatcagtgatacatcgacatcctgatactcaaattccggcgcttcatacgggcttacatgtttagccattgttgttttgagccattcgtcatcattacgttcaggataatccggtttataatgggcgccccggctttcattacggttgtatgcgccaagggtaatcaccctagcaagctgaagcatgtttgagaactggcgtgtgaacatcgctccctggttgctccattttgtcgtatcattgatgttgatctttttgaagcgctccattaactcctgaattttgtcatccgttttcaaaagcttgtcattatggcggacaaccgttacgttcgccgtcatccactcaccgagctctttgtgaagaacataggcattttcggttccgtccatactcataatatcagcccatttttcttcttctttcttaacgtgagcgtcgaataatgatgaagacatgtcttccgctgaagattctaagccgtttacatatttcaccgcattcggtccggccaccatgcctccgtaaatcgcagacagcaaggagttcgctcccaagcggttgccgccgtgcatagaataatcacattccccagccgcaaacagtccagggatatttgtcatttgatcgtaatccacccataaaccgcccatagaataatggaccgccgggaagattttcattgggagcttacgcgggtcgtctcccatgaatttctcataaatctcaatgatgccgccaagcttaatatcaagctctttcggatctttatgagacagatcgagatataccatgttttcaccgttaatgccgagcttctggttcacacacacatcaaatatttcgcgtgtcgcaatatcacgcggcaccaggtttccgtatgccggatatttttcctctaggaaataccatggtttgccgtctttatatgtccacacgcgaccgccttcaccacgcgctgattcactcatcagtcttaatttgtcatcgcccggtatggctgtcgggtggatttgaatgaattctccgtttgcataatacgctccctgctgataaacgattgatgcagcagatcctgtattaatcatggagttcgttgattttccaaagatgattcccggtccgcccgtcgccataatgacagcgtctgaacggaaggattcaatttgcatgtttgtcaggttttgtgcaacaattccacggcaggttctgtcatcatctaaaacagcgccaaggaattcccagccttcgtattttgtgaccagacccgcaacttcgtatctgcgcacttgctcgtccagtgcgtaaagcagctgctgtcccgtcgtcgcaccagcataagcagttctgtggtgctgtgtacccccgaatcggcggaaatcaagcaggccttcaggcgtccggttaaacatgacgcccatccggtctaataagtggatgattgaaggcgccgcttcacacatcgccttgaccggcggctggttggcaagaaagtctcccccgtataccgtgtcatcaaaatgttcccacggagagtcaccttccccttttgtattgaccgctccgtttatgccgccttgcgcacaaaccgaatgagaacgtttgacaggaacgatggaaaacaacttaaccgccattcctgattccgctgctttaattgtcgccatgaggccggcaagaccccgccgactacgataatgcttgattgactcatgatagcccctctccctctagtaatctagtactcttaaacaaatgcgaaaatcgcttttaagcctacgtatgacagtgcaacaaaaataatcagcgtaacgtatgtcgaaattctttgagaacgaggcgttaccgtgatgccccatgtaacagcgaaagaccataaaccgttcgagaagtggaaaattgttgataaaacaccgacaatgtaaaaaccaagcatagccggagagctcaaaatattcgccatcatgtcgaaattgacctcagcgcccatttgtgcggcaatgcgggtttcccacacgtgccagctgacgaaaatgagggtgatgataccggttacacgctgcaggacgaatagccagtttctcatgtagctgtattgacctgcgttatttttcgcagtaaacgctatgtacacaccataaactgcatgataaattaatggtaagaagataataaaaatttccaaggcatacctgaaaggcagactatccataaaatgagcagcgctattgaatgcttcagcgccccttgcggcaaactggttgacgactaaatgctgaataagaaagatgccgaccggtatgacgccaagcaaggaatgcaatcttcgaaaataaaactctctgttcccagacattactttaccccctgtttgataagtgcgaaatgtgctaaatctcttcccccacttctttcaattgtaagcactttattaagatttattgacaatttcattttactcctccctcaaaagggcgtcaagaaaacgcgtacataaattataattttccgaattgattagttgattgaaaaattttattttatcaatatatatttcttgcttaatttttcataagaattacaggatcattctgtaatcctccccctgtttaagctataatatacgcaggagagaggggagacagatatgaagtctaaatttgaagcatctattgacaacctaaaagaaattgaaatgaacgcctatgcctacgaactaatacgagagatcgttctcccagatatgcttggccaagattactcttccatgatgtattgggcaggaaaacatctcgcccgtaagtttcctcttgaatcatgggaggaatttccggccttctttgaagaagcgggctggggaaccctcaccaacgtaagcgctaaaaaacaggagcttgaatttgaacttgaagggccgatcatttccaaccggcttaaacatcagaaagaaccttgctttcagctggaggctggttttatcgctgaacaaattcaattgatgaatgatcagattgccgaatcatatgaacaagtgaaaaagagagccgataaagtggttctgactgtgaaatgggatatgaaagacccagtgtaatcaaaaaggcggtgactgcatagtcccgcctttttgattgtcattacacagctgaagggtgttttgaaagctcaaatgcatcgtgaagcgactcgactgctttcaccatgtcattttcgcttacgactgttgacactttgatttcagatgtgctgaccattttgattaaaatgtttttttgcgccagtacagcaaacatttcagccgctacaccgggatttgagaccatgccggatccaacaatggatactttagccaatttgctttctgtctcgattttctcaaattccagcgcgtctttatactcttcaagcaccgcaacggtttggtctgcatcttctgttttgacagagaaggaaattccagtcttgtcctcggcctgcgtttggataatgatatccacgtttatgtttcttttggcaagtgtcgtaaaaatagtagacaaagttgtcagaccgctagtcagcccgtaaatggttactcttgtgattcgatcttcaaatgcaattcctctgacaattaaattctgttccatggatgattcctcctcaattaatgttcccgcttcggtttctgtacttgaacgcacttctaacggcacttggtaatttttcgcgaactcaactgctctcggatgaagaacgccggcgcctaaattggcaagctcaagcatttcatcgtatgagatgcccgcaagttttctcgctgatttcacatagcgcggatcggttgtaaacacacctggcacgtctgtgtatatgtcacatttatcagcttttaaagcggcagccaaagcaactgctgttgtatctgaaccgccccggcccaatgtcgtaatttcacaatcctctgtcatgccttggaagcctgcaacaatgacaatttttcctttttcaagctggtctgctaaaaccgaagtgtcgatatctgtaattctggcgtttccgtgaatggcctccgtacggattcccgcctgccagccagtataagacacagcgtcatagcctttttcctgcaatgccattgaaaggagtgaaatcgtgacctgctcgcctgtcgccagcagcatatccatttcgcgtttgctcggctggtcagaaatagcttttgcaaggctgaccaattcgtcagtggattttcccattgctgaaacgacgacaacgacttgatggcctttctgtttttctgcaattgcgcggtttgccgcattttgaattttttcgactgagccgacggaagtgcctccgaatttttgtacaataagacccatgtattaccaccctttacattttggttcgtgcgggtgaggagaaagagcgctttgtccacaataaaaaaagcaatgagaggaatactctcattgcttatcaattaatcatcatgaatgattatgaacaacgagatagccctccaagaaaatgatttcttgacagccttacatttattcaatgcacggccagcaaataataccgatggggttttatttgcttcggcgacgctcccctttcagcctttttcacagaatccatctttctccaaaggcatactcttgaagttcgcacctctatcttcaccatataacacgatctaactatgaaattagttcacattttatcagatcttatttaaaaggacaacattatttttgcaatttgtcgtaaaggagctgagccgccgctgcgggaacaccggcttttttgatgtcctcaaggcttgcttccttcatttttttaacggaaccgaaatgctttaacagcattttctttcttttctctccgatacccgggatgtcgtccaaaacggattgaaatgcgctttttccgcggatttgcctgtgaaaactgattgcaaaacggtgcacctcgtcctgaatgcgctgcaggaggtaaaattcctggctgtttcgttccagatacaccacctccagcggatcaccgatcagtaaatttgaggttctgtgtttttcatctttcgctaaaccggcgatcgggatatccaagccgagttcattttcaatgacatcccttgctgcgttgatctgcccttttcctccgtcaatgatgatcagatcgggcagcggcagattctcacgaagcactctcgtatagcgtcttctgacaacctctctcatagaaccgtaatcatccggccctgtaacggttttgattttatatttgcggtattcctttttgtatggtttgccgtcgataaacacaatcatcgcggaaaccgggtttgtcccctgtatgtttgagttatcaaacgcttcaattctgtgcggcgtataaatatttaatgcctcacctagtttctgcacagccccgattgaacgctcctcgtcccgttcgattaaagagaatttttctttcaatgcgattttcgcatttttatgggcaagcatgagcagttcttttttcgggccttttttcggctggtgaacgtttgtttccagcagctgctcgatcatagattgatctacgctgtccggaactaaaatctccttcggaaggaagtggttgttttttgaatagaactgcccgatgaacgtgaggaactcttcatctgcttcctgataaagcgggaacatgctgacatcgcgttcaatgagctttccttggcggatgaaaaagacctgcacgcacatccagcccttatcgtacgcgtacgcgaacacatcacggtcgactagatcgttcatcgtcattttttgtttttccatcgttgattcaatatgggccatttggtcacgaagctcttttgctcgttcaaactcaagattctcagcagcttcatgcattttctcttcaagctcttttttgacctcattatagccgccccttaagaaacgtgtaatgctttcaaccagctctctgttcgtctcttcggaaatatcctttacgcacggagcaagacattggcccagatgataataaaggcacactctgtccgggagcttggagcattttctgagaggatacagacggtcgagcagtttttttgtttcccttgctgcctgtacattcggatacggcccgaaatagcgccctttgtcttttttgacattgcgggtgacaatcagccttgggtggcgttcatgggtgagttttatgaaaggataggttttgtcgtctttgagcatgacgttgtatttcggatcatgctttttgatcagattcatttctaaaataagcgcttcaagattggaggacgtcacgatatattcaaaatcctcgatttccgtcacaagcctttgggttttcgcgtcgtgagaaccggtgaagtaggagcgcactctgtttttcagcacttttgctttccctacgtagatcacagtctgctgccggtccttcatgagataacaacccggttgatcgggaaggagggcgagtttttctttcagttgtttgttcatatgttacccttccttatgtttaatcctttatatccagtttaacacgaacgtttgtttttctctatggttcacaattggcgaataaaaaaagcgatccctcaatcggaatcgctctggcatgtaagcagcggaaaattaaagatgtttgtttacaagctcttgaagcgcttcttttggtttgaagccgactgaagtttcaactacttcgccgtcttttaacacaagaagagtcgggatgctcataacgccgtattttccggcagtttcttggttttcgtctacatcgatttttacgattttcagtttgtctcccatttcttgatccaattcttcaagaacaggtgcaatcattttacaaggtccgcaccaaggagcccagaagtctgccagtacgacgccttcgcttgtttcagctgagaaagattgatcagttgcttttacgatagccattattgaattcctccaatgtgaaatgatgatttttagtatagcatctcccattcgttcacgctattttaatgcttacaaattattttttcctgatcacagccggtttactcatttttatatggttgaatgggatatgctctttttttaaaacacaaatctgataatggccccgatcactacaattgccccaataatcattaaaatggtacgaagcataagatcacatctcctcttcactgtcatgtactttaccatgccctgccggagctgttttaaaacctgaaaaagagcgccggcatgaagctccggcgctcttgcgcgattaagaatcagcacgcagcgtaagtaagacgactgacattggcgggagttttactttcagtttgtttttgctgagcgtgtattgtctgaaggattccggtttaacatgatgaggatcgtcaaacgtgttatgcgcattcattttttctgccgtaagaatgactccggaatggtccgctgccttttgtaggcctctcagctcgatttccgcctccgctttgttttggtgatcgatgttgcaaattgtgatattgatatcgccttcagcttgtttcgacgctgaaatgctgatttgcggaagcgtttcacccttccattcatagtcggcagacattgtctctgttgctaaaagagaagcgtcctggtgcaccttaaacatattgaatacatggtacgtcggtgtcaaaagcatccgcttgccctcagtcaaaatcatcgcttgtagaacgtttactgtttgggcgatgttggccatttgcacccggcggcaatgctgatggaaaatgtggaaatgagaagccgccaccagtgcatcacgaatggtgttttgctgatataagaaaccgggattcgtgcctggctcgggatcaaaccacgtgccccattcatcaataatcagcccgacccgctgctccggatcgtaccggtccataatcgtgccgtgtttttgaatcaattcatcgatgtatttggcttttttcatcgtaataaaccattcatcttccgtgaattctgtggctgatcctttgcccttccagaaatcccccggaatcgtgtaataatgaagactcaacccgtccatcaggccagcggcttttttcataagcacgtccgtccaattaaaatcatccacatttgcgccgcctgcaattttataaatttcattcccgctgtaattgcggacataagtctgaaaacgccggtacagatctgcgtagtattcgggatgcatgttgccgccgcagccccaattttcattacccacgccgaaatatttcagattccaaggctcttctcttccattttgttttctccagtctgacatcggcgtgccttcttcaaatgtcatatactcaatccactccgccatttcctgaacggttccgcttccgacattgccgcaaatatatggctcgcattcaagcagctcgcaaagcatcataaattcatgcgttccgaattcatttgattcaattgtaccgccccagtgagtgttcagcattgtcttacggtcaccgacaccgtttgcccaatggtattcgtccgcaaaacacccgcccggccacctgaggacaggaatgtgcagctgtttgagcgcctccagcacgtcctttcgtatcccgttgatattggggatgtctgagtccgttccaacccagatcccctcataaatccctcttcctaaatgctcagcaaaatgaccgtatatatttttgttaatggttccttttacgatatctgtttgaatcactgcttgatgttcagacatgcctctgatcattcctttcatacggatatgaaaagcaccacagtcaaatatgtgatctgtcttttgcctgaggagtcagcatgaatgtaagcgcttttaaagtaaccatattatatatgttcgtacatgtcaacgacattttctattgtttttatatttgtacgtatgtatttataaatatgaaaaaatcccgaacttttaaagtccgggatttcctttatgagtgtatattcaattgtttgaattcctcagttaataacgggacaacttcaaataaatcaccgacgatgccgtaatccgctattttaaagatatcggcttcggggtctttattgatggcgacgatcaccttgctgtttgacatgccggccaaatgctggatggcgccggaaatgccgcatgcaatgtacaaatccggagtgacgactttcccggtctgcccgatttggagagcataatcgcaataatcagcgtcacatgccccgcgagaagccccgactgcggcccctagcacctctgcaagcgcctgcagcggctgaaatccttccttgcttttgactcctcggccgcccgcaacgataattttcgcttcggagagatcaacaccgtccgccgtttttttcacgacctcttgaatcacggtgcgaaggtcagtaagagagacattcatgctttcgatgcttcccgacctgctgatgtctttttctgaagcttgaatgttattggggcgaattgttgcaaagatcatcggatcggttgaaatgacgcgttcaaaagctttccccgagtaaatcgggcgtgtgaacacaacattccctccggtaacgcttacatctatagcatcagaaattaagcctgtttgcagccgggcagcaagcttcggtgaaagatccttgcccattgccgtatgcccgaagatgactgaatcaggattttcttgctcgataacacctctcatgacctggctgtacccgtctgccgtgtatgttttcagcttcgggtcctcagcggtaagaactttatctgctccgtaatgaataagctcttgtgcaatgctttgtatattttcaccgatgagaacaccgatgacttccccgtctcctgaaatggttcttcctgcagctattgcttcaaaggtgacattccgcaattccccatcgcgtatttctccaagcacgatcactttttttcccattctaacatccccctgtttctttgaatgtccaagctttaaatgactttagcttcgctgcggagcaatgagacaagctcttttgcctgttcggcaggctcaccttggagaagcttcccggcttcttttttcggcggcagaaaacgctcaatggttttcagctttggttcagcatcctcttcgtccaggtcaagatcatcaagttcaagctcttcaagcggctttttcttagccttcataattcccggaagcgatggatagcgcggctcgtttaagccctgctgagctgtgacaagcaatgggagcgtcgttttgattttttcaacatccccttcgacgtccctttctgcttctgcatcagtgccgttgatttcgagtttggtgatcgtagtgatacatggaatgtccagtagctcggcaagccgaggcgccacttgtcctgatcctccgtcaatggcaacatttccgccgagaatcaaatcaaactcctgatccttcatatagtggtataaaacttgagaaatggaatattggtcgggttcttcgagatcatcttctatgttgattaaaacagcttggtcacaacccatggcaagcgccgtacgcaattctttctccgcttcttcaccgccgaccgtgacggcggtgatcgtgccgccatgcttttccttcagctggatggcttcttctatcgcgtactcatcatatggattaatgatccattccgctccgtcatcctgaatctttcctgtttcaatgacgattttttcttctgtgtcaaacgtccgtttcatcagtacaaatagattcatgatcatatccccttttattcgcctttgaactgaggctttcttttttcgagaaatgcctggatgccttccttggcgtcctctgactcaaatgcttccccaaatcgttttgcttcaagctttaagctgccttcataggaatacaccttgttggaataaagaagctcaagcaaagacgcgagcgtttgcgggcttttctctgcaaacttagcggcaagtgcttttgctttttcaatcacttctgcctcatctttcgctccaattgagacaagtccgagatcaagcgcttcttttccggatatcggttctcctgatccgatgagctctaatgctttggctgtaccgacatatctcggaaggcgctgtgtccccgcaaaacccggaatgataccgagattaagctccgggagccccagcttagcatcttctgctgcgattctgatatgacaggccatcgcaagctccagcccgcctccgagagcagcgccgtgaatcgctgcgataatcggttttggaaagctttcgattctctccattaactgctggccgcgctcagcgagcaatgaggaatcctcattgcctttaagcgatgtaaattctttaatatcagcgccggctgagaaaaatcttccctcgccgtgaatgataatgcttcgtacgcctgcatctgtctcacattgatcaagacaggaagacagctcttctaatatccggctggaaagcgcatttgccggcggattgtgaatcgccaaaactgccacaaattgatcaactgccagtgatattgcattcataggacagaactcctttacttattatgaattccggacaccaataattctaaaacgctgtctgaaagcgaagcgagatcgtacttttggtcattcatcacccatgttgtcacggtttcatcaatcgttccaaaaatcatctgccgggcgaggcggacgtcgaggccttcttttaattcgcctgattgtataccttccgtcaaaatgccatccaaaatatttaagtagccttttaatatttcgttgattttttggcgcagctccaagttggattggcggagctcaagctgcgtgacaatcgcgagattatggtcacccgctaaaagggaaaaatgctttgaaatcacaagcgccaatttctctttcgctgttgctttttctttaatgtcctcttccatcctctcaataaattgacccattttttctttgaaaagagaaattaaaatatcttctttgtttttaaagtagagatagatggtgccgtccgctactccggcttgtttggcaattttggatacctgtgactgatggtagccgttttctgcaatgacttctactgctgcatcaataatctgcatatactttggccgtttttgcttcaatgttcatcgttccttcctatagaaatgaatgactattcattcataattttatgataagaaggattttcaggtttgtcaagtttattcatggacgttctctttttttatttgatatgatgattttcggtttcttcttcaagtaaacgccttcttaaaatttttcccaccgccgttttcggcagctcttttctgaactcataggctttgggcaccttatagggagctagacgtgatctcgcaaaagtgtccagttcttctgcatcggcttttgtgcctttctttaatacgacaaatgcttttactgtttctcccctgtaggaatcgggaacgcctgcgacaacaatttcctggatggcttcatgttcataaagcgcttcttctacctcacgcgggtaaatattgtaaccgccggcaatgatgatatccttcttcctgtcagcaatatagaagaagccttcttcatccatatagcccatgtccccggtgaacagccagccatctctcagcacagcggcggtttcctctggtttattccagtatcctttcatgacttgcggaccttttacaatgatttctccatgctcatacggagcggcaagctcacccgtctcttcagaatagatcgcggcgtccgtactcggccaaggacagccgatactgcccggcttgttttttccccagataaaattggcgtgcgtcactggggatgcctcagacaaaccatagccttccacaagctttccgccagtcaccttttcaaatttctgctttacctccacggggagcgcggctgatccgctaagacagcttttaatggatgacagatcataatgctgcaattcggggtgatgcaaaaggccaatgtaaattgtcggtgcgccaggaaagagcgtcggtttgtgtttgtcgatgattttaagtgtttcgagcggatcaaacttaggaagaagtatcatttcgaagcctagtttaatcgaatagttcatgactgccgtcagtccgtagacatgaaaaaacgggacgatgcccagcactttttcagcgccttctttcacgtcatacatccaagcggcgcacatttcagtatttgccaaaatattttggtgcgtgagcatgaccccttttggagctccggttgttcctccggtatactggaggacagcgatatcatgctcaggatcgatcttcgggattgtcaggagttcagttttttcctgcttcatactggaagcgaacgtgtgaatgttagctgttttgtcaaagtcgatatgcactttttgtttttgcgtcagcgggtaaagaatattcttcggaaaaggtaaatagtcttttacgctggttatcaaaatctggtcgactattgataacgttttcatttttattgccttcggaaaaagcaaatctaaggtgatgattacacttacctgagcatctctaagctggtattcaagctcatgctcggtataaagcggattcgtctgcaccacgatgccaccggcaaacaagacgccataataagaaatcactgtttgcgggcaattgggcagcataacagccactctgtctcctttttgcaggccattgcactgcaaaaaagctgcaagtttaagagcatccgtcagaatgtcatgaaaggtgagtttttttccataaaacgatattgcggttttatcagggaatcgtgcggcggagtctgtcaggatggattgcagggttttattcggcaacggaagctcatgcgggatatcgttgggatactcggcaagccacggcttttgagactgcataaaacctcccctttcgattttagagatccaccttatcattatagcagatggacggcaaaaaaaagaaaaagaaaggtaaatctttctttttctcataatatgaacagatatataagaccaattaacaaaaagattcccgccgcggcgagcagtattttcgcaagcttttccatttattctccgtccccttatattccggctgccactacaaatgaaagcccgacagaaatgacaaatgaaataaagccgacagcccggttatcattttcgatttcctgatcaattttaaaccgcggagtcaaaaactcaaaaataaagtagctgatcagaagcataacaaacccgtaaacgccccagccgatcatttgcagaagcgaattatgctgggagatggaatgctgaaatacgtttgcgatccccaaaatttttccgccggtcgccattgccaccgcaagatttcctttttgaatctcttcccagtttttataagccgtcaccagctcaaacacagtcaaaaagaggacgaggcagagaaccgcgacactgtaatatgccgcgatttccacaagctcgttttcccaaaaatcactcatggccatactcccttttattttagttcaactaccgtaacgcctgatcctccctcacctgcttcaccgaaacgggaacttttgacgctgcggtggtttttcagaagatcctgtacgccttttcttaaagcgccggttccttttccgtggatgattgacactcttggatatccggctaacaccgcatcatccaagtatttttcaacccggctgagggcattttcatagcgttcgccgcgaagatcaagttcaagcgatacgtgatagtcctttcccttgaccgctgtaatcattttttctttttttggctccggagctgatttgataaactccagatctttttcttttactttcatctttaaaataccgatttgaacgttccattcattgccgcctgttttttcgagcaatgttcctttttgcccgaaagtgaggactttcacctcgtcgccaggcttaaagtcgcgtttttgcgttttcggcttttccggtttcttggacttttcaaaagcaggcatagcgccttctaaccgtttcttcgcgttaatcagctcgtgatccttgaaggatttgtgttcttcttttatggtgcgcaattcatgaataatgtcctcggcttctttcattgccgcttttactttttcagcagcctgctgttctgcctcttcaagcattttgtcttttttgctgttaagctcgatgatttgctgctgcagctctttatgcagtttttccgcttcttttctgattgattctgtctcagaaagctcttcttccgcacgttttttgctttgttccagcgacgcaatcatcgtatcgacttcgttatgctcggccgtcatttctgacttcgcctgcccgatgatatggtccggaagcccgaggcgttttgaaatttcgaaagcattgcttcgacccggcacaccgattaaaagtttataggtcggtgacagcgtttcgatgtcaaattcaacgctggcattcatgacgccttctctgttatagccgtacgccttcaattccggataatgcgtcgtagctaacactcgtgcattggtgcgatgcacgtcatccaagatgctcatggcgagggccgccccctcctgcgggtctgtccctgcaccaagttcatcgaaaagcacaaggctgttttcattgacctgttctaaaatgccgacaatgttcaccatatgggatgagaacgtacttaaactttgctcaatcgactgttcatcaccgatatcagcgaatacgtgctcaaatactgccgcttctgacccttcatctgccgggatatgaagacctgattgcgccattaaggttagcaggcctaacgttttaagggtgactgttttccccctgtgtttggccctgtgatgacaatggttgaaaaatcgcggccaagctcgatgtcattggcaacaacctggtcaggcggaagcaatggatggcgggcttttttcaaacggataaagccggtgtcgttcataatcggttttgttgctttaaccgcttttgcatatctagcttttgcaaaaataaagtcaagcgtctgcagcacttgcaaatctagaaatagctcctctgtatactctgccgttttctctgtcagcacacgcaaaatccgttcaatttcttgcttttctttcactttcgtctgttgaagggaattgttcatatctacaatcgcctgcggttcaatgaatagtgtcgcaccagaggatgaggtgtcgtgcacaattcctccatagctggatctgtactcctgtttgaccgggatcacaaagcggtcattccgaatcgtaacaatcgtatcagacagcattttcgatgcggaagaggaacgcagcatcgactctaaccggtctctgactcttgattcgagtgttctgagctgtgtgcggattcctcttaatgtttccgatgcatgatcaagcacttctccgtgatcatcgatgcaggaattaatgtcccgctctaaatcggacagcgtgataagctgttcagcatgctgatggatcagcggaatgtcgacaccgtcttcagccatttgggtgataaaatgtttcatttgtttaactgcataaagcaggcctgagatttcagtgaattcagatggactgagaacgctgccgatttccgcccgtcttaacgctcctctgatatctacaaggccgccaaatggcgcttggcctctcagccggataatgtcagaagcttcgtctacttcatccagctgttttttgatttcgtctatagaagcagaaggcttaagctcgagaagcatttcttttccgagcgatgaagcggcatgcccaataacctgttctttcactttatgaaattcaagagctgataatactttttgctgcacgattgtgtgagcctccttacttaatcgttgcgcttcagaaatgcctctacgtctttaagcgaccgggcattcagaacgtttttcgtttccgtccatcctttgcgcgcggcagtaacgccagttttcatatcgtctaacatctcaatattatgggcatcagtattaatcaccaatgtaaccccttgttcatttgctttcattaaatgctctgtgcgcagatcaaggcgcgcagggttggcgttgagttcaagcgccgtatttgttttcctcgcaagctcaatcagctgatcaatatcgatttcgtaaccggcccgtctgccgataaggcgcccggtcgggtgtgcgataatgtcaacatgcttgtttgtcagtgccgtctcaagccgtttcataatcacgtgttccggctgattaaaactggaatgaatcgatgcaataacgatatccatttccgcaagcacatcgtcatcataatcgagcgtaccgtcaggcaggatatccatctcaacgcctttcaaaatacggaagttttcgaactctgcattcagcgcgtcaatttcttttgcctgctgcttaagtctttctgcagtaagcccgttggcaacctttaaatattgtgagtgatcggtgatcgccatgtattgatagccttttttgatgcaggcttcagccatctctctgatcgaaaatgcgccatcgctccacgttgagtgcatgtggagatcacctttgatttgcccgagctctatcagttcaatgctgtcgctgtaagtttccacttcctgtccgctttcacgaatttccggcggaatcagcggcaggccgaagtgcgcataaaattcacgttcactcggaaatgttttgatctctccggtttcaactgtctcaacgccgtattcactgatccgctcgccgcgttctttggcgatttggcgcatcttaatattgtgatcctttgatcccgtaaaatgatggagtgttgtcggaaactgctcttccgtcacaagacggaaatcgacgcttgtttcatattcaaaggaaaggatgacggacaccttcgtatctccgcttgcgatcacgcttttgatgtttggcagctcaagaagctgctctcttacttcagccggatgatctgtagcaatgatataatccagatccttcaccgtttcccgcgctctgcggagacttccggcacgggaaaatttgatgatatgcgtaaattgagaaagatgctcctcaatttcccgcgcgatccggagggcgtatccgatcgggaaccgttcaggctgttttccggcttccccgagcgcctgtaatattttttcttccgattttttgccgaagcccgcaagaccctggaccttttgctgctcacaggcttccttcagagattctgcatcgtgtacgccgagctctttatacagctttgcgatttttttgccgccgagccctggcagcttcaataaaggcacgagtccttccggcacttctttctgcagcgattcgagcgtgcttgactttccttcatctatatactctttaatgacgctgtacgttccttttccaattccggacagcgacatcatatcgtccatttctgataagcttcggtcgtcctgttccaaggctgccgccgcttttcggaaggcggatactttaaacgggttgtcccctttgagttccatatagactgcaatggtttcaagcagccggataatatcttttttatgcatatcataaccccagacgttcacatatgtttccatcatacttgaaaaaaacttctccggacaagagaagttttttatgccccgtactgtgtccacagctcttgtaggagccctgacaagtatggtgtatggttaatgatcacatttgcgagggacgattgccccatcatttgctgcagtgcatctatcggaagaacggatgcgacatacagcagcacaaatgtaaataaatagacttctagaaaaccgagaacggcgcccagcatctggttaatttgtttaatcaccggaatgccggctacaatactcaggaacgagccgatgattctcagtaagattttagcaatgataaataaaacgataaacgcaatcgcattatagtacgctgcttccaaattccccgtaaaaaaagaaagagccggctgtcccgctgaaaaatcgggtgcgggaatccaatgtaaatgcggtgccacgtttttatagaataaagccgcaaaggcaattgataaaataaagctcgtcaagcggataaactgcaggataaaaccgcgttttaaccccagtaaagtccccatcaggagcaagattaagatgatgatatctagcatagttgttcaatccttttctttaagctgacgctccagtttttcacatttctcttgtaatttgacataatcgtgcaccacatttaccgctgtcagcactgcaagtttatttatatcaaggtatggatttttttcattgatttctctcattttatcatcaacaattccggcgacatacctcatatgggctctgctttcttcaccgacaatcgtgaagtgctggccgtaaatgtcaacggttgtttttgtttttttgccgtcagacaacgtttctcctccattccgcgagaatcctagttcttatcataacacgtttattaaatgaatggaaagacgagcctcccgctgttatgatacactggtatatacagtgaaaagtgtaaaaaaaggagattattacgtgtcccattcagtgataaaagtatcgttgtctgctattgaccaaatgaaaatgacgtacagcggttcgcttacagcctctgttccgcagggagccgtttttcaggcgaaaccgcccggctgtaccattacagcatataaatcaggcaaggtcttgtttcaaggcaaaaacgctgcggcagaatccgcgcgctggggaacagcagagcctcaggaaaagaagaaaacggccaaaaagccggctgatccccgctatgcccctccggcagatatcgccggaatgtctgttatcggttctgacgaagtcggaaccggagattactttggcccaatgacggttgtatgtgcgtacgtcgacaaaaccatgcttcctttaatgaaggaactcggtgttaaggattctaaagatttaaaagatccgcaaatcatcgagattgcccgaaacctgatcaaaaccattccatatagcctgctggttttaaagaatgaaaagtataacagtatgcaggaaaaaggcatgagccaagggaaaatgaaagctttgctgcacaatcaggcgatcacccatttattaagaaaattggatggagtaaagcctgaagccattttgattgaccaattcgctgagccaggcgtctacttcaatcatttaaagggcagagacattgtgaaggagcggacctattttagcacaaaagctgaaggtattcacctggctgtcgccgctgcttcaatcattgcaagatattcgtttttaatggaaatggataaactatcacgcgcggcaggaatgacgcttccaaaaggcgccggtccgcacgtcgatgaagcggccgccaagctaatcctcaaaaaaggggcatctgaactcagaacctttacaaaactccatttcgccaatacgcaaaaagcgcagcgccttgctgataaaaaacgctcatagaaaaaagcttgcagatttctctgcaagcttttttcatattttcagcgtgattgaaaacccttgaagtctaggaaaggcgagcattggagcacagcgaatgttctaatgcgtgagcaccaacgcgcagacctgacaacgaatgcgggggtttgccgacacgctgagcttgcatttctctgcaagcttttttatcatcctcttaaaacagcttgatatgtgtcttccaacgctttcagcactttgctgtgcgcctttgtcacttcttcttcagtcagtgtttgttcaggattgacatactggagtgagaaagcgactgacttcttgccttcctccatatgttcgccttcgtatacgtcaaagacggttacctctttcagaagcttgccgccagcctctttaatgacgctctcgagctgtccgcttgtgacggttttatctgttacaagggcgatatcacgtgtcacagacggatatttcggaatcgccgtgtaaacaagcggtgctgtttctgctgcgagcaacgcatgaagatcgagctcaaatacgtatgtttcctttatatccagttctttttccaatgaaggatggacttggccgatgaagccgatcagagaaccattcaataaaatgttcgctgttctgcccggatgcagctgtttgcgttcagactgtacaaattcaatgctgtctaggacgttgagtttgtctaacagcccttccacaattcctttgacaacaaagaaatcaactggtttcttttcaccctgccatagctgcttgcgccataatccggtaacagctcctgctacgcgttctgtttcaacaggttttgtgtcctcttccttcgttaggaaaacggagccaacttcgtacagtgcaactgagtcagtctgcctcgcaaggttgtaagaaacagaatcaagcagattcggaacaagactgtgtctgagaatgcttctttcttcactcattggaagcgcaagcacagtattcagtgatttttcaatcgcaaacgctgccgctttcttctcgtttgtcagtgagtaagtgatggcctgtgataagcctgcgccttcaaggaagcgtctgactttacggcgttttgcctgatatggcgttaatccgcctgtagttcccgctgtctcaggaagcgtagacggaatgttatcgtagccgtacagtcttgccgcttcttcaattaaatcctcttctattgtaatgtcgccgcggcgtgatgggacagtcacaacgagaagttcatccgcttcaccgaccgtaaaaccgagacgtttataaatgctgatcagttcttctttactgatcgtcaggcctagaacgctgctcactttgttagcagatacgtgaatgttatttgcttcgattgtcaggtgatcttcctcaactgttccagcaagcacctcaccgccggcatacagatggatcagctgcgcagcccgttctgctgcaagacgtacgcgcgccggatcaattcctttttcaaatcttacgcttgattcacttctcaaaccaaggtctttggaagccttgcgaaccgtctgcccgttgaaatacgcagcctcaagcaaaatcgttttcgtatcttcctgaacctctgactctgctcctcccatgacacccgcaacggcctgcgctttcattccgtttgtaatgacaaggtgatcggcggacagcttacgttcttgatcatcaagagtgacgatcatttcattctcagctgcttttcttactacgacttccttagagccaaatctgtcataatcaaacgcatgaagcggctgtccgtattccaacaggacaaaatttgtgatgtcaacgacgttgttgtgcggacgaatgcctgcattcatcagctttgtctgcatccaaagcggtgacggagcaatcgtgacatttttaatgatttttgcagtgtacagcgggttcgcttcttgatcttcaattttgactgaaatgtaatcagacgcttgttctgaagcagccgggtaatccgtttgcggaagctttacctcagtgtctaaaattgcggcaacctcgtaagcaacaccaagcatgttcatggcatccgcgcggtttggcgttaaacccagctcaagaatcgcatcgtcaagctgtaaagccgctaaggcatcgcttcctgtttcagcgtcattagggaatacgaaaatgccttctgcatactccttcgccacaagtttgctttcgataccaagctcctgtaaggaacagatcatgccatttgattcttcaccgcgaagcttggcttttttgattttgaaattgcccggcagcaccgctccgactgttgcaactgcgactttttgtcccttatccacattcggcgcgccgcaaatgatttgtacaggggcttcagctccgatatccacaaggcacttattcagcttatcagcattcgggtgctgctcgcgctccagcacatggccgatgacaatgcctttgatgccttctcctttgtattcaattccttcaacctcaataccggctcttgtaattttttcagcaagaacagccgggtccatgccttttaaatcaacataatcctctaaccatttataagaaacaaacatccttacatcctcctcttacgcctgtttaaactgcgaaataaatctgacatcgtttgtatagaagtggcggatatcatcaatgccgtatttcagcatcgcgatgcgctcaacacccattccgaatgcgaagccctgatattccttcggatcaaagccagccattttaagcacgttcgggtgaaccattccggcaccgaggatttcaatccagcctgttcctttacatactgagcagccgttcccaccgcatttaaagcatgtcacatccacttctactgaaggctcagtaaacgggaagaagcttgggcggagtctgatttcacggtcttgcccgaacatttttttcgcaacgagttcaagcgttccttttaaatcactcatgctgatgtttttgtcaacgacaagcccttcaatttgcataaattggtgagagtgcgtcgcatcatcgttatcacggcgatatactttacccgggcaaatgattttaacgggacctttgccttcatgcttttccatcgtccgtgtttggacaggggaagtttgcgttctcatcaaagtctcctctgtgatgtaaaagctgtcctgcatatcgcgcgcagggtgttctttcggaagattgagcgattcgaagttgtagtaatccgtttcaacctctggcccttcctcgactgtgtagcccataccgataaataaatcttcaatttcttcaatgacaacagtgagcggatggcggccgccgactgcaacagggttccccggcagcgtgacgtcaattgtctgtcctgcaagcttctgtttcatttcctcttcttcaagcttctcgtttttgtcagcaatcgcattggcaatacgctcccttacttcgttcgcgagcgcccccattttcggacgttcctcagcagaaagcttgcccattccgcgcagcacttctgtaatcggccctttttttccgagatattgcacccgaatatcattgacaaccttcaatgagcttgccgcttctacttgttctaaagcttcttgttccagctgttttagcttctcttccattttgcatcctccttttatgtaaacaaaccgtcatatgtctttggaaaataaaaaaaacccgtcccttgtacaagggacgagttgtggccgcggtaccacccttatttcagacagactgatgctgtcgtcagcttcattgacataacggaatcagattccggttcacctttacgcgcagtgtacgcggtcccggcgacaactcaagaggtgaagccaatttccggctgcgttaaaaatgctctcagtcagcggcattttctccctggaaagcagttgatcagaaattgaggtcctctgtcacggtttttgaaatattatgttctattatagagaaatccaacgcttggcgcaacactatcctcgcaagtgatacacgaggatggcagccgcaaccgcaacgtttagtgattcagcctgtccgtaaagcggcacgtacaggttcaaatccgttttttccagcaatgcagcatccacccctgcaccttcatttcctacaatgagcgcaaaggattcagactgaggaatctcctggtaaggcgctccgttttgcagcgccgtgccgtatacttttacgccctctgccttcaattcgtccacatatgaaggcaggtttcttctcacaacaggaatatggaagtgagatccttgagcagatcgcagtgtttttccgttaaaggcgtccgccgtgccgtcaccgagtacaaccgcatccaaaccggccgcatcagccgttcgaatcattgtgccaaggtttcccggatcttgaacagcgtcaatcagcagcaccttgcgtgccgttgccagcttttcttcaggcatatggcacacagcggcaatctgctgcggcgtttcggtttcagtcacagctgaaaacgcatcttcactcagcatatagcactggataccagtctcaagatctgaaggaatcttcgtttcatcctttacaaggatttctttcacaatgcccgggcttttcaacgcctcttcaacgagatgttctccctctatcagaaatgtatttgtttttgttcgttctttttttgtgtgaagctttttccaatccttcactttttggttttttgccgattctatttgtttcactgtctatgtggcgctcctttttttaacatgatgttattatatcgcaagaacagcacataataaaccaggtgcagggttagaatatacgtattacattttagaaaaaggagcgttttacatggatcttaatttacgtcatgccgtcatctccaatgtcaccggcaataatcaggagcagcttgagcatacaatcgtagatgcgattcaaagcggtgaagaaaaaatgcttccagggctcggcgttttattcgaagtcatttggcagcacgcatccgaaagtgagaaaaacgaaatgctgaaaacgcttgaaggcggattaaaacccgccgaataagacatgaaaccgggtgacagcgcccggtttttttcttatataataaaaacatgatgagggggaacgccatgtttttacagccgttattagcgaaaaaaattattgctgaagttaaaaaaatgtacgaacgtgaagtcattattgtaaacacggacggtcttattatggcaggcacaaacgatgagcgtgtcggacaatttcatgagggagcgcttatctgcgcaaaagaaagacgcagcgtgattattacaaaagaagatgaaacaagattaaaaggagtgaaagcaggcataaacctccctgtattttttgaccatgatgtgatcgccgtcttcgggctgacaggtgagcccgctgagattcagccattcggagaactgcttcgaaaaatgacagagctgttcattaaggaatcacggcatttagagcaatcccagtggcgtgagagaatgctggagtcctttatgatcgattggctgcaattaaaggagtggtctcccagttttcttgagaaagctcagcttcttggtgttgaccttgcctcccggcgccaaatgattcttattcaggggtatgagttgtcacctcatgatattgaacaaatggcacgcagctggaaatcctcgtaccctgcggatttgttcatcaggtggggaaatgaacggatcttgattaatcatgaagtgccgcagcatgaacaaagggatcggcttttacggaagatccttcacatttgttcgtttgccaataccgcaaacagccaatttgcagcagctggcgccggaagagccgtcgcaagctccagcctgacagattcatacgagcaagcggaaaaagcgctggctgtcagccttaagcgaaaaacgcccatatttgaagaggatctgaagcttgatatgtgtctgacggagatcagcccgggaacccgaaacgaatttccgcaaagagtattaggagaggcgcttgagcatcaggaacttatgaatacgttacggactttctttcatcacgatttgtctttgaaacaaaccgcagaagatatgcatattcatatcaatacattgcgttatcgtctggctaaggctgaacagctaacgggtttacgttttgaccgtaccgaggacatcgtcacgatgtacgttgcactctattttttagatcaagatacaaaatagagagagtttcagtttcattttttgtatgtttctccatggaaggctttgctttttttcttttacaatagattgaaagcgttttttgacagggggatgggtgaaatgatcaccaaggatgtaaaggagcagctgattcgggtctccggaccagaaaactttgatgactcgaatgccggccgtctcgtctattcatatgatgcgacgcctcagtatcagtctatgcctgatgccgtgattgctccaaggaatactgatgaagtatcacgcattttaacaatttgcagcgaacatcgagtgccgatcgttccaagaggatcagggacaaacctgtgcggcggcacgtgcccgactgaaggcggacttgtgcttctctttaagcacatgaaccggattcttgaaattgatgaagaaaatttaactgccacagttcagccgggcgtcattacgttggatatgatccgggcagttgaaagcaaaggtttgttttatccgcccgatccgagttctatgaaaatatcaactatcgggggcaacatcaatgaaaattccggcgggctccgcggattaaaatatggcgtcacccgcgactatgttattggactggaggttgtgctcgcaaatggtgacatcatccgcaccggcggaaaactcgcaaaggatgtggccggatacgatctcacacggctttttgtcggctcagaaggaacactcggcattgtgacagaggcaatcgtcaaacttgttccaaagcctgaaacaaaaaagacgctgcttgccctatatgaaaatatcgatgccgctgctcaaacggtatcagacatcattgccgcaaaaatcatacccgccacgcttgaatttctcgaccagcctacacttttggtgattgaggattatgccaaaatcggacttccgacaaacgcaaaggcggttctattaattgagcaagacggaccgcttgaaatcgtggcacgggatatggaaaagattgaggcgatttgcaaaaaaggcgacgccgtttccgttcagaccgcacaaacagaggaggaagcgtttgccctgactgaagcccggcgttctgcactttctgccctagcccgcctcaaaccgacgacgattttagaggatgcgaccgttcctcgctcagaaatcgccaatatggtaaaagcgattaatgatattgctgctaaatatgatatttccatttgcaccttcggccacgcaggagacgggaacctccatccgacatgcacgacagacataagaaatgaggatgaaatggaacgtgtcgaacaggcttttgccgagatttttgagaaagcgattgaacttggcgggacgataaccggagagcacggagtcggggaaatgaaagcgccttacttggaaatgaagctgaaaaaagaaggcattgatgcgatgaaagcgttgaaagcggcatttgacccccggaacatattaaatccgggcaaagtgtttgcgaaagatgccagaaaacgtgtggtggcggaaagatgacaacagaaaaagaaatgaaacagatccaaaatgaatttaaagagcgtatggatgaaggcgagttattaaattgtatgcgctgcggcttctgtcttccttcctgtccgacctatatcgaatcgggatttcaggaaacacactctccgcgcgggcgtatcgccttaatgaaagcagtagcggacggtatgattgaaccggatgaagatgtcgaacggtcgctgtcactttgcctcggttgccgcgcctgtgaacctgtatgcccgtcaggcgtgaaatacggacagctgcttgaggaagccagagatattatccaccaaaataaaaaacactcgctcggcgcacgtgtcatgcgaaagacggcttttcacgagctgtttccgcatcaaaaccgcatgcgctcagctgtaagccttatcggtttgtatcagcggtcaggactgcaaaccgctgtgcgtaaaaccggtatgcttcgcgtcctgcctgagcatttgcgaacgatggaagctgttcttcctgatgttccaaaaagcaaagacatgaaacatcggccgcgtttcctgccgtcaattggccccatgaaaaaacgggtcgcctttttttcgggctgcttaatggatacgatgtttttaccgactaacaatgccacattgaagcttttacagctggcaggctgcgacattgtcattccgcctgaacaggcttgctgcggggcgctgcatggacacagcggtgaaaaaaacacagggaaagagctagcgaaacaaaatatcgctgctttcgaagcattagacgtggatgcagtcattacaaacgcaggaggatgcggagcctttctgaccgaatatgatcatttgctgaaggatgacccggaatggtcggagcgggccgccgcttttgttcaaaagctgaaggatttttcttctgttttggttgaactcgatttccatcaaatggacttagcgctcgagacgcctcaggtcgttacctaccaagattcatgccacctaagaaatgtaatgcatacgtcgcttgcgccccgccagcttcttaaaagcatcaaaggggcggaattcaaagaaatggagaaagcagacagctgctgcggatcagcgggaatttacaacatcgtcgaagctgaaatgtctatgagaatactggacagtaaaatggctgccgtcaaagcaaccgaagcgatcctcattgtaacagcaaatcccggctgcctgctgcaaatgaagctcggcattgaacgcgaaggactaagcggtaaagtcagagccgttcacctggctgatttgctattggaagcagccgggcacaaaacatcatgagaaagcccaaaacagatattgttttgggcttttgtgcgttattccatcggactgcaaatttcgatataatgtccatccggatcagcgatataggcgaccgtctgcccccatggtttcactttcggctccccgataatcgatacgccttgttctctcatccttttgatgaccgcttctacattttcagtaacaaacccgatttcaaatgtgtttgaagcagatgtatccggaatgtccagcgccgtgatgtctctggcgctttcccgcgtattaagcgccaatatcgtagaccctgtatcaaattcgacatacgtgccgtgttcagcacgaatcggcagtcctaaaatatcccggtaaaaatgaatagcccgcttgctgtccgatacgtatagaataagatatttcattgatagattcattgccaacccccctcagcattttcaatagtccttctagcccggtatagatgcttccatccttaagctcggatctttccacatctgcgcccattttttcacagccgccacaataatgatgaagcctaacaccagcatgatgatagataatacgccattcaatacactatatcctgctgcttcaggattgagatacacattgcgcaccatccaatagcccgcataattgacagtgacatataaataggcaagcgggataaggcaagtcagaatgtaccggcgtttatcagcgattttcagcacgatggtcgctccgataatcagccccactgaagccatcagctgattagaaacgccgaacagcgcccaaatggaaccgatatctcctgaatacagcaagtacccccacatcaaacaggcaagcgcgctggcaaatatagagcccggaatccagtctgttttcttcagcggtttatacacctccccgaagaaatcctggatcaaataacgggcgacacgtgtgccggcgtcaatcgctgttaaaataaagaccgcttcaaacataatgacaaattggaaaaagtatgaggccaaatggctgaaaaacggcattccggtaaaaatataagtcatccccaccgcaagcgtaacggctcccctgttcttccttctaagtccaaaccgatttccctgctcaattcaggcaaatgtacgacattcatgccaagcgtacggaaaacctcaggcgtgctgttaatcgcaaagtaatcagcaggctgtaaagcggtcgctgcaatcagcgccatgatgccgacaagacactcaacaagcattgcgccaaacgcaaccggcttcatatcactccatttattcagcattttcggtgttgttcctgagccgacaaaggcatggaacccagagatcgccccgcaggcgatggttattgagatgaacggccagacaggtcctgccagcaccggcccgccgccttttacgaattctgtaaacgcaggaaacggaatagacggattgacgacaaacacaccaacaatcaaagcgataaaaacaccgattttcataaagctgcttaaataatcacgcggagccagaagcagccaaacgggaagcgcagccgcaaaaaacgcgtaaacagggagcgcgattgcaagcgttttcgtatctagcgttaaaaagtcaccgagcgcggtagtctgtacccatggaccaataaagactcctgccattaaaaagagaaagccgaccgttgaagcgagctttaaatttcccgttttcttataaaataagcccacacccatcgcaatcggaatcgtaatccctaccgcaaatgttccccatggattacgttcaagcgcatgcaagacaaccatcgacaggcccgccattgtgatcgtgatgataaacagcatggacagacctgtacaaaatcctgcaacagggccaagctcatccttcgccacttccgacagcgattttccgtttttgcgcatcgatgcaaacaacaccacaatatcatggacggctcccccaattaccgccccgattaacagccacaataatcccggcaaatagccaaactgcgccgccagaattggtccgaccagcggtccggccgctgcgatcgcggcaaaatggtggccgaacgaaacccatttatttgtaggcacatagtctttcccatcctcaagcacgtgagcaggtgtcggcttgtcatcatttactttgagaaccttcaccatcataaatgttccgtataaacgataggcaatagccaaaatacacattgacgctatcacaattgtaaccgcattcattttctcccatcccctttgctgtttttcataaatatatcataatttcatggtgaaaagcggtcattttttcctatacaaaaagccggcttgaacgggccggctcgtggcagttgaaagacaagccggagagaaatctccggcttcgcttctcttatgactcttttttcaggcgtatcacattccaggaaagcggcgtgaaatgagcagttaagccattttcgctgacagacgatgatccgttggaatgcggaacgacattttttctgttatgctggtttgtcgctttgatatcctgatgctcaagtacgatgtgctctgcgatttggtaggattcaaagcctctgagcgaaatctccgtctccatctgatcctcagccttgtttaccgcaaaaatagtgagtgtttcttcctcttcagagtacacaacagcagcatcaacatatggcacatcagtgaaatcagaacaatcgtacttaggagaggaaataagcggtttcagtgactcgccccttccgtaaacagaagcatgcatgtatggatagaaaatcggctgtctccatgcttctccgcctttttccgtcatgatcggcgcgatgacattgacaagctgtgcaagacacgcaattttcacacggtctgcgtgctgcagcatcgtaatgagcagagagccgactaataaggcatcttcaaaattgtaaatatcctctaaaatcggacgcgcagtgatccacggctcgacttttttatcagcctcatttgagtggtaccagacgttccattcatccagagaaagattaattgttttcttgctgcgtgtttttgcttttacatagtcacaggtcgcagcgactgatttgataaaatgatccaaatccatagaacgtgccaagtagtttggcagattgttatcccggtttccgtagtaggtgtgaagagagatatagtcgacatgctcatacgtatgctccagcaccttcgcttcccaatcgataaaggtcggcatgccgctgtttgagctgccgcaggcaacgagttcaattgatgggtcaacccacttcatgacctttgctgtctctgcggcaagccgtccgtattcatcagctgttttgtggccgatctgccacggtccatccatttcgtttcctaagcaccatgttttgatgccatacggctgttcatagccatgcgatcttcttaaatcactccagtaagagcctttcgggtggttgcagtattcaacgagattacgggcggcatctatgcctcttgtgccgaggttgacggccatattgacctcagtgttcacctttttggcccaagataaaaattcatttgttcccacttcattggtttctgtcgtttgccatgccaagtcaagccgtctcgggcggttttcgactggtccgacaccgtcctcccagttgtatccggataaaaagtttccgcccggatagcggatgatgggaacctgtaattctttgatcagcgactgaacatcttttctaaacccatcttcatccgcttcagggtgatcaggctcgtatatgccttcatataccgcacgacccatatgttcgataaacgagccataaatccgtttatctacttcaccgattttatattctttgtctacaatcattcgcgcttttttcatcacacgtttcctccttcattaacctttgactccccctaccgtcaggccggagataaagtacttttggaaaaacaagaaaatgataatcaccggcaaaatcgcaaatactgagccggatataagcatgtcgtaattatttccataagggctcagcaagctggacagccctattggaagcgtaaacatttctttcgaccgaagcacaatcagcggccacaagaagttgttccagctgtttaaggactgaaggataatcatcgcaccgaaagccggtttcatcagcggtgccataatcctgaaaaagatgccgaattccgtacagccgtccatccttgcagagtccagcagatctcttggaaggccaagagcatattgcctaaaaaagaaaacggcaacaggtgaaacgataaacggcaatatgacacctgtatatgaatcgatcaagtgcagtccgacggtaagcttaaacagaggaagcatcatcacttccagcggaaccatcatgataatcagcacaagaacaaagatgatatttctgcccttaaaatcataaaccgcaagcccgtacccgatcatcgaagaaaaaaacagggtgagcatggttgtgaaaagcccaagtacaagactgttaaaaaaccatttgaaataaatgcttccgccgttaaacagaaatgtataattatcaagactcattactttaggatcaatgtcgagattgagccccacacgcaaaagctcagatgacggctttaatgatcctaaaagcaaacagaaaatcggaaaaagatacaataggctcagcataataaaaaacagggttagtgcgattctgtaaacgctgaactgaggactgtgccgcaacatttatccctcccccttaaacgagcctgacagctttaatgaaatcaggctgacaacaaggatcacaatcaaaagcacgatgccgatggctgctccgtaccccatttcgttgtaggcaagtccctgctgatacaaatatccgacaagcgtcagaccaatattacccggggaattattctgccaaaggacgtagctttcctcaaacatcctgaagccgccgataatgctgatggtcagcacatatacggttacaggcttgagaaacggcagcgtgatgtgcagaaattttttcattgtattcgcgccgtctatatcagcggcttcgtacagctctttcggcacattttgcaaaccggctaaaaagtaaaggatgttgattcccatccatctccatgaagcaagcagcaccatcaaaaacatgccggtatgttcattgttcatccagttctgaggtgaaaagccgagtttgagtaggatggaattggccagagacgtttccatttctccgaagatcagccgaaaaatgatccccgcgacaatggtggaggtcaatgccgggatgaatagtgctgatttaaatatatttctaaatttgaccagctttgaattcaggaatatggccagaagcaatgggacaggaatcagcacgattagcgtccaaaaggtgtattccagcgtattccaaagggcggtatagaacgtcgggttgtttagcgctgtataattagacaatccgacaaaggacacctctcccggcaaaattctttggaagctcatgatgaagacactaatgatggggtatagaaaaaatacgagaaaggataaaacgaatggcgctgtaaacagatagggcgccgctttttttgaataaaatagatctcgccagcctgattgtttcgcagctgaaggaacgggatgaaccgttcctgttttcacaggtttcatgagaacctccccgctttcactttttgaatgggattctatttctgtttcagttcacctgccgctctgtccaaggcttgtttaggcgttttttgctgagatttaagtgcgtcgaacaacacgcttctgttgacaaggtctgaagccttggcaaaatcctcatgtaaataaatcggattgatttcatccttgatatcgagcagcacggaaaaaatgcctgttccgttttggaagtaatccgtgtatttgtttttctctttcaattccttggagctccagacatcccagcgaagcgggtcaaacccaagtacgctccagagctttttgtttccttctttagagcccttcgcaaaggctaaaaactctgttgctaactcaacatgcttggcttgcttcggcacaacggttgccgtaccgcccaaacctgccgagcggtcgcctccctctttccatgccgggagcggcctgatggcaatcttccctttcagatcaggcatatagtcgataaatcttcccatataccaaatcggcatgaggactgaagcagctcctccttggttcataaagccgtagtattcttcactgtgatgcccgccgcccggcgcaggaatcatcgttttatcattgattatgtcttttaaatattgaagtgtttttacgttggtgtcattattgaggatcagcttgccgtttttatcaaaatagcctgagttttgctgtgaaatcatagataagaacgttccggaatcatttgtttccaccgttcccatcggcttcccggtcactttgcgcactttctgtccggctttatggtaatcatcccatgttttaatatcgtcaggattgacgccggctttcttcataacatccatgttataaaacatgactgttgttcctacatgcgtatcgagtccgtaaagcttgccgtttttgctgtacagggtcagccgcgcctcaacgaatttatcacggtccttttcaatcagcggagtcaagtcggcaagcggtatgtcagagcccttcaaaaagtttgaaaaacgggccaattcgacatcggcaatatcagggacgccttctcctgcaattaaggagatagacaagttatcgtgcatttgtccatacggataaacgaccgtattcagcttaattttgcggtcaggatatttttcattccattccttcaccatttctatatagaactgctcatgaagtccgttaaatgtccaaaaggtcagctcggtttcacccgacttcccggatgatctttctgctgaacacccagcaatgactaatgtcagcagcatcatgagcacaagaaaacagacagtcatttttttcatctgcgttaccccttccattcgaggtgcgggctattcatatagaccatggttgatcagtgttttgttttcattaatgattcttaatccggtgcagcggtctcttaaggtatgcgcgtgtctgaaggcattcttgacagaatcctgcccgacaccgatttcgtcaaaatacgcagggcctccggctgatctcagccaatcagccagcacttctccttccgggagagtttgataagccgattggatggcttgccgccggctcggtgaaaattcgttgagcccgtcatccttagcgagctttctgtatgtgtcagttaataaaacagctgcacagcccacctttgccccatgaagaatctgtggccgttttttctccattaattccatctcaatccaatgtgaaatatgatgctctccgcctgatgccgggcgggaatgatctaatgccagcatgacaagccccgatacaagtaaagactccatcaaaacccgtatgcctgtttccgttttcatcgcaatgtcttctgtgtgttcaatgcaggcagcaagcgcctcctgaacaatcttagctcctgctggcgaataaggctcgccggcaagatgccgggatatttcccaatctgctaaagacgttattttaccgagcatgtcaccaaatccagccgccaccattgactgcggtgccgcttttaatagatccagatcagcgaacagtgcagacggggccttcgtttgaatggttgttttcgtaccgtataaaataatcggcgcccctgctgatgtaaaaccgtctacagatggagcagtcggataagaaataaacggcaaatctctttgaaacgctgcaaagcggacgatatcatgaatcgtgcccgaaccgactgcgatcatgacatccgttggttgtttcgtatggatcagcacatgaatgagcgatcgttcatcagctgtcacatctccggcttcattttctggaatgatcaggcactcggcctgaaatccttcttgattcagctgattttccagatcaattcctgcaatgcggtgtgtattcgcgtcgcagacaaggacaatatgtttattgttttttcgttttacataatccaaaagcgaatcagctgcttgtttaccgagaacaatttcttcaacttttataggcaacgtcttttctccggcgtgttcaaaagcacgctgaacgtcagctgcgatacgattcatatcagaatcccctcctcagccaatttggttacatccttaacagaatccagcacataatccggcgtgtacaaacgctgttcgccctgtttcgcagaaccagttagcactaaggcgcttttcatgccataaagcttccccatcgcaatgtcagattcaatgctgtctcctataatcatgcattcatgtgcggacagccccattgctgtacaggcagcctccgccatcagccatgacggctttccgacaacaagttcagtcttcgcttgtgcggaagcctctatcgccccaatcattccggccacatcaatggcatttccgtcttcgttcggaaaagagcggtctttgtttgtagcgataatacgagcgccgccggcagccgcttgaaaggcttgatttaaatcttcgtacgtgagcgtttcatgaagggagatcacgagccaatccgcttccttcggttcgttcgcgttctgcacaccggccagcctcagctcgtcaaccaagccttgctccccaagcacccatacctttgaaaaacgataatgttttttcagaaaagccgctgtcacgcttgatgacagaacaatgtcgtttacgtccgtttcaatccccgcgccaagaagtttttttctgcacatggcacgggagatattcccccggttgcttaaaaagacgattttctttcccattctcctaagcgttttgatcgcttctcttgctccttcgatcaactcatttcctctgaatacagtaccgtccaagtcaatcagaatgccggccggtgacacaggcgtatcatgactggccataatacgcatttgctccgtgttttcgataaaaatgcttttcatgcagaactgtattgattggggttacatccttgttcagcataatggagtgataggccatttcggcaaccgtttctaatacaactgcgttatgaatggcatttaaggcgtcagtgccccagcagaacggtccgtgattattcacgagcacacccggcacctgttcgtagttatgatgctgaaaggtttccgctatgacttttcctgtattcaattcgtactcatgaatgatttcttcatcgtacatttctctagtacacggaatcgcactgtcaaaataatcagcatgagtcgtgcctaaaggaggaatgtctctgcctgattgcgcccagcttgtcgcccattgagaatgggtatgaactattccccgatattcggaaaagctttatataaataaacatgggtaggtgtatctgaagaaggcttaagcgagccttcgacgacctctccatcaaggttcaaaacaaccaagtcatctgctgtcaagtcgctgtattcgactccgctaggtttgatgacaattctttctttttcacggtcaatcccgctgacatttccccacgtaaaggttaccagctgatgctcttgaagcttcaggttggcagccagcacttccttttttaatgtttcaagcatgctccatcaccctttatcaattctttttggcggcagatgaaaattgaagatttttgatcgttttcagacgcttcatgacatggttttcttttccgaaataatgaaccagctctttatattcagcgtacaatttttcataaaccgcggcgttttcggcatttggcgtataagttatatctttcagttttcccatgttcgccgctgcttctttgatgtcatcgtatccgcctttttctttgcctgctgcaagcgcgccgaaaatggcagatcctaaggctggggcttgcggtgaaccagagattttaatgtccatgtttgtcacatccgcataaatctgcatgacaaacgggtttttctcagctattccgccggctgcgaacaattcctcaatcggaacaccgctttctttgaatgtttcgataatcatccgggttccgtaagctgtcgcttcaactaacgctctataaatctcttcaggcttcgtcagcagtgtcatgccaagcagcatccctgttaaatctgcatcaacaagagttgaacggtttccattccaccaatctaaagcaagcaggccgctttcacctggcgcttgatggtttgctttctcactcagcagctcatgaacgccaatgtttttttcctttgcttccttttgataagctggcgggacacatgttttcacaaaccagtcaaaatgatcgccgacacaggactgcccggcttcatatcccgcatagcccgggagaattccgttgtccacaacgccgcacatacctggaacgatatgcacctcttcaccaagaagaacatggcacgttgaggttcccataatcatcagcattttccctggctctgtaatgccgaccgcaggtacggaaacatgagcgtccacattggcaaccgcaacagccgttcccgggagaagccctgtcagctttgccattttttcagtcagactgccggctttttctcctactgaatgaatagaacctgacaatttgtcctttgtaatcgttttcattgaaggatttaatttctcaaagaaatcatctgacggataccccgctttttcactccacatcgctttataccctgcagtacagttgcttcgcttgagcgagccgcacagctggtacacgatccagtccgcagcctcgatgatccggtcagccgcttcatagatgtgaggcgcttcctcggcaatttgcatgacctttggaatcatccattctgatgaaatttttcctccgtaccgctgtaaaaaagcctctccttcttcttccgcgatttgattgagccgatcagcatgtttttgagccgcatgatgcttccagagcttcacatagctgtgcggctcctcttcatattcaggcagcatgcataacggctgcccgctgctgtcaataggaaggatcgtacatgccgtgaaatcaattccaatcccgataatgtctttcggttcaacgcccgtctgttcgagtaaagacggaatggttgtttccaagacttcgaggtaatcagcagggtgctgcagcgcccagtcacgcggcagcttttgacccgtttttggaaggacggtatcaatgacagcatgcctgtattcttttacagcagccgcaagttcctcccctgtttggacatgaacgagcactgctcttcctgataaagttccaaaatcaacccctattgtgtaagccatgtgacatccccctctacttttgaagccggtaaagcgcctcgttccattttaactcgtgtttcagtttatgaattgtcgtatcacgggaaatgagaacactttcgattcccgccatttccgcccaatcaagcatttgctccgctgtaagttcataagacaggcaggtatggtgtgcaccgccggctaaaatccatgcctccgctgctgttttcaatgacggctccggcttccagagaacacgggcaaccggtaaattcggcatgtctttttcaatttcctggccgttgacttcattcagcacaaggcggaaacgcccgccaatatcaacaatgctagcttgaatggcagaaccgctgatgccgttaaatacaaaacgcgcagggtcctctttgccgccaatcgaaagcggatgaacctcgattttcggctgatccaaagcgacagtcggacacacttcaagcatgtgagagcccagaatcatttcatttcccggttcaaaatggtacgtgtaatcttccatgaaggaagttctttttcctttagccatgattttcatcatccgtacaagggccgctgtcttccaatctccttcaccggcaaacccatagcctttctccatcaggcgctgaacggcaagtcccggcagttgtttcattccgtgcagcacttcaaacgatgtcgtaaacgctgtgtatccgccttgctcaaggaaagcggttaagccaagttcaattttcgcctgttctttaatggacgctacctttgcttcgtcacgttttgtttcctcactgatcacatatagtctgtcatactcggcataaagcgtgtcaacctcgtcgtccgtaatgcgatccatcacttcaacgagttccccgatgccatatccgtcaacctgccagccaaattgaatatgcgctcccaccttgtctccgtccgttaccgcgacatgacgcatgttatctccaaatctggcaaccttaatatgtctgctttcatttaatgcagccgccgtatccatccactgggacatttcttttttcacttcttcatcatcccaatagccggcaatgacttttcggctaagccccattctcgagttgatgtaaccgtactctcgatcgccatgcgcggattggttgctgttcataaaatccatgtcaatcgtaccccacgggatatcgcgattatattgggtatgcaaatgcataagcggtttttgataagaggaaaggccttctatccacatttttgcaggggaaaatgtgtgcatccatgtaatgatgccagcacatgtctcactgtactccgcttctcttaacagctctctaatggtttccggtgaagtgacgacgggcttatgagtgattttatatctggaagaaaccccgctgagcccctcacaaatgcttttagcatgctgatctaccagttccagcgtctcttccccgtataggtgctggcttcctgtcacaaaccagaattcataatcctttgtctgaagcatgtaaactgcccctttctcataaaataaaacgctttcaaatataaaagatacgtactaatgatagaaaataaacctataaataaatatttgtacgaacaattttattatagtaattgactattatactgtcaatcttttcttttaaaaaaagccgggggcagagcccggctttttgattcaataggacggccagcccgagctccaattcaaatcattgatgagaagcttcggaatgccattgtcattggcatcataggcatggcgaacaagaatgtttccgttcacaatatcctggcctccaggtcctttccattggtcattgcccgaatccaaaatagtgcctccgccttcaagcatgctttttccgcttttatcaagataagggctgtaatgtttttggatcttccgtaagcaattttgtacgtactgtttaccccgtcacagcatttatcaaatgaaaccattaaatagtaatatccattttgatacgtaagagtaggagcttctaaggcacctccattattcggtctagctgcaatcgaatagagcgagcctgtaggcttcatcgtactcttatcgagcttagtcagcttaatgccgctccaaaacgagccgaatgcaagccacgggttgccatccttgtcgaatgtcagctccggatcaatggcgttataattatttgagcttgtcgaacgaatcaccaagccctcgtccttccagctccccgaactgatgcttgttgaagatgccaggccaatggcagatgtattgcttccaaaagaagaaacggaataatacagccagtacttgccgttatagtattggatgtccggcgcccactggttttgaccataattcggcacataattggaccaccacgatagcggtgtagtgaaaatggatttttgtacggtccaatttttagcgtctgtagacttcaaaacccgcagtccccgttcttcagtaagccctgttccgagcgcataccatgagctcccctctttaatcatagtcgggtcatgaagcagctcattggatgcaccccaaaatgctgcctctgcgggagcagcagaagtgaatatcaaacctgcagccagagctgcactcgaaaagtgtaagaagcgtttccatgtttttttctttttcaattttgttcaacctcctttatttcagaaagcgcttacaaattagattatttatcctcccttcctgtcaaatcgactgcgtatcgtatatcgtcatgttcaggaaattttcggtatcccctttattgtagtcactatgctgtaatttgtacagacaaaaaaatagaatccacctcaacaggcggattcttccgtatctttattggtacgtaatttcgtcaaccgtttttcggtctaacttcttaatgacttctgtaattaactttaccgcgttttcataatcatcacgatgcagcatggccgcgtgcgtatgaatgtagcgggttgcaatggtaatggacagcgcaggaacgccatttgccgtcaaatggatggcacccgaatcagttccgccgccggcaatggcatcaaattggtacggaatgccggcttcctccgcagtggctacaactgcatcgcgcaaacctttgtgagagaccatggatgcatcgtaaacgataatctgcgggcctttgcccattttgctctgcgcttccttctcggaaatgccaggcgtgtctcctgctattcctacatcaacaccaaacgcaatatcaggctgaatggtgtgcgcagccgttttcgctcccctcaggccgacttcctcctgcacggttccgacgccatacactatatttggatggtctgtgttttgtaagtttcttaacacatcaattgcaatcgcacagccgatgcggttgtcccaggcctttgcgagtaggaatttttcattgttcatgaccgtaaactcaaaatgcggaacgatcatatctcccgggagtaccccccactccaaggcttcttcccggcttgaagctccaatatcaataaacatgtcttttatttccactgatttttttcttgcttcaggagacaaaatatgaggcggcttagatccgataacccctgtgatttctcctttttttgtgacaatggtgacgcgctgggcaagcataacctgagcccaccatccgccaacggtttgaaaacggataaagcctttatctgtgatttgtgtcaccataaagccgacttcatccaaatgtccggcgatcataattatcgggccattttctgcaccagtttttttggcaattaaactgcccaggcgatctgttgtcacctcatcagcaaatggttctatgtatgatttcatcacttgccttacttctctttcattgccgggtatgccttttgcatctgttaaatctttcagcatggtcaatgtttcatctaattttgccatgttccaaaccctccttcatcagtcctgcattcttattatacaaaacatggcgcgaaccatacgactatttcacttgaaaatcgggtatatgtttttacagctttcttttagaaaaagtgaaacctttttctatgcttttcgtattacatcagatcatcaccataagggaggtgccttcacacaatgtttgtcatggttctaaggattattttgcttgcactttttgcttattgtatttatgccgtggtcaaatatgtcgcgaatcctaagagaaggcttaagctggcccaatcaaaagaacatttttatattattgatgaacaaaacaatacccggaagaattttcagctgacgtataaaggcgtgctttttgagggagaaaagcatattccttccaaggatcatccgctgtttattcacacgatctttgtctggacagaatctcctgagaagctgaaacatttctctgcaaaagattttgagaacattgaagaaaaagtgctggaacgatatccaaattgtaagattgactgggaccagcccattaaactcgcaaaaaaagcagaagagcgttaaacgcttttctgctttttataaatcaaacgggctgtagtaaatagcgatgagaatcgcttcaattaccagaagaagcggtactccatacttaaaagaagcgtgtttcgttttatgtctgaaggtttgcatgccaagccagacaccgagcgctccaaacacgatggctatcagccacagccggtcttcagaaattctccacttgtgctgctgcgctttgcgtttgtcaatgcccatcacccaaaaaccgcacagattaatcaacaccaaataagcagcaataatcatgttgcctcatcctttatatagaaaaagccgctctgctggagagcggctctatatgattacttgtttaattgagctttagcagcatcagcaagctgattgaatgcagtaagatcgtttacagcaagatcagcaagcattttacggtttacttcgataccagaaagcttaagaccgtgcattaaacggctgtaagaaaggccgttcatgcgagcagctgcgttaatacgagtgatccaaagtttacggaaatcacgttttttctgacgacggtcacggaaagcatagtttccagatttcatgacctgctggttagctactttgtataatgtatgttttgaaccgaaataaccttttgctaatttaagaacctttttacgacgcttacgtgtaacagttccgccttttactcttggcattgaatttccctcctaattgttccttatccgattacttgatgttagcaagcatttgtttgatacgtttgaagtctcctgcgcttacaacagcactcttgcgaagcttacgcttttgcttttgagatttgttggcgaataagtgacttgtgtacgcgtgagaacgttttaacttcccagaacctgtctttttaaaacgtttagcagatccgcggtgagttttcatttttggcatgggatttcctccttattgcttttcgtttttcggtgcgagcattaagaacatgctgcggccgtccatttttggttttgtttcgactgtcgcaacctcagcacatgcttcggagaaacggtctaatacacgctgaccgatttctttatgagtgattgcgcgtcctttaaagcggatagaagctttcactttatcgcctttttcaaggaatttaatcgcattgcgcaatttcgtgttaaagtcatgctcatcgattgtcggacttaaccgaacttcttttaagttaatgattttttgattcttgcgtgcttctttttcctttttctgctgctcaaatcggaacttaccgtagtccatgattcggcagacaggcggttttgcattcgctgcaactaacacaaggtcaagatttgcgcggccggcgatttcaagtgcttcctgacgggacttgattccaagctggtcgccattttgtccgattaaacggacctcacgtgcacggataccctcattaaccaattgatctttgctaataatgagccacctccatagtttcttcgaattgattcacaactcattttgaatgcattttgcaggcaaacaaaaagtgtgggcattataaaacacccacactacgaacatctgtatcaataaaaatgtacggtcaacctgccaactacatgcatgtgtcaatcaggtgagaagcgggtgcttctgcttgtgatttatattcaattcaataactattctacacaataccggatctttagtcaaggacgacttatccggaacaactttttcattgtaacatgggttttctatgagcgcaagagagaaaaagaaaatctttcagcctaaccaagatgcaaagaaccaacaattcccccttattacgcaatttacaacaaaaccaccgacaggaagaaatgtaaaataaagttaatctctgaccgatataagaagcagaagggagcctgacacatgaacaaactgatacagcttgctttatttttcacattgatattaaccggttgctcgaatagcagcacatcttccgaatcaaaagtcgaaaccactgttaagacaactgcagcatttcctcaaaaggagctggagaaagagctaaaaaaactaaagcccgtttcattggacatgaagttcgagagtccactcgctactgagttaggaaagcggaaggcaaaagaggaagctgaaaagcaaagacaaatcgccgctgagaaaaagcttgaaaaagagcgggaggcgaaacgaaagaaacagcaggaggaaaaagcggagagacagcgattagcagagcagcaggctgcagagagacagcgattagcagagcagcaggctgcagagagacagcgattagccgaagcggaaagacaagctgaacttgaaagacagcggcaggcagcaatccaaaaagagcagaaagcgaacgctgagaaaaagcggcaatcacaggcacaacggcagcagactgaggcaccctcatctaatagtcaagatccaccatcttcctcgagtcagacagataaaaccattcaacagccagcttcagagcttcctgatgacgatggttatggttatgaagaacgaaaaaagtggcatgacgatcaagtagaatggggcattaaacaagggtatatcgatcccgaagacgcaccataaaataaaaaaagccaaggcattcagccttggcttatcctccgatcagctgcacgaacacagggatgaccagaaccgttaccactcctactacgacaacagcaatacttgccatcgcagcttcaacttctcccatctcaatcccgaccgctacaccaagtgcatgtccggatgttccaagagccaatcctttagaaatcggatttttcactttaaacaccttcaagaacaatgctccgagcgcatatacgatgacagcgttaaagatgaccgcaaaggctgtgatgtcgctgatgcccccgatgccttttgataaaggaagcgcaattgccgttgtagccgcctgcggaagcatgcttttcattacggccgaatcgagatgaatgcctttagcgagcaaataaacaatcgtgacagagcagatagagccggcaataatggaggccatgatttgccaccagtactttttaagcttatctctttgtttgtacaaaggaattgcaaatgcgatcgttgccggttcaaggaaaaacttaatgatctctcccccgttattataatccgcgtaggaaaaaccgccgatttttaaaaatgcgatccccagtaccatggcaacaaacaaaggagtgaaaaggaagaagcctttcgttttcttaaataaaaaggtgccgatgccgaatgcagcaagtgatacgacaatcccaaaataaggactcattgtgctttccatgtgaagaacctcctgtttcccttaatggtgaacgagttcgttattgttctgcgggctttgcactgtttttgttttcatgtccgctgcggttttgcgttttccgctcagcgaaagaatcagctgagaaaacaatcccgtagcccccagcaaaataatcgttgcgagcagaatgacaagaacaatttgcaggccgtattgctgcatcacaccaagcgaattcataacagatatacctgacggaacaaataaaaatccgatcagagaggtcaaagacgttccgagcgtctccacttgttccagtttaatgactttcaaacataataggagaaataataagaccaaccctacaaccgatgccgggataggtattgggacaatagcggcaatcatatttgaaaccagcataatgacggcaaaaataaatgcttgtgttaaaaacccgtacacttttttagcactcattttcttcacctctttctctttggtaccccattataaataagaattccctgttataaagcgcttacaagataacatgccgaatagcgggtctgagttgcagaatcaaatggctgaaatgcaaaaagccgcccatcaaatatggagcagctttttcaattccttcgcatatgtccggctgaccggtattttcgatccgtctttcatgatcaaattatacgttgaattaaaccatggctgaatttctttaatatattcggtattcacgacaaagctccgatggacgcggataaaatcagaatccggcagctttttctcaatcacaacgagtgtatcgctgaccgtataagaatgatcgaaggtttttacattgacatgaccatcttctgttccggcatagataatgtccttcgtatccacaatcacaatcgattcccccacagatagcgcgagcttgtgctggccggcatggctgttttgctctgtttctacaatatcccgattgacttttttatattttttcagcgtttgctgaattctttcttcatcgaatggcttggttaaataatcaagagcatccacctcaaacgctttgagtgcatactggtcatacgctgtcgcaaacacaacagcaggaggatgcttcattttcttcaatcgctttgcgatatcaaaaccgttttctccggataaatcaacgtctaaaaacagcaaatcaggtttttgatccatcatttggtcaaaagcgcattcgatattttccgcttcattgatttccatttcctcattggtccgcttaagcaagtaagccagttcatcccttgccagcatctcatcatcaactattaacaccctgagcatgttcttctccctctttcatctgttgcattggcacttgaaaggaaacctctgtccctttatgaacctcactgctgatatgcagtgcagcctgctgtccgaataaaccgatcagccgctgatttaggttataaagcgctgtaccggttccctccttagacggaaacggtttcttccccagttccggcaagacgtccggcggaattccgcgtccgttatccgccaccttcatatagacggatgcgttatcagataagacacagactgtaaccttgcatatgtcttgttttttcggaaacgcgtgccgaagcgcgttctcgacaagcacctgcaaaacaaacggagggatttcaatctgctccagtctgctgtcgatattaagctcaattttatatttcccgggaaaacgcgcctgttctaatgacaaataggcgttaagatggttcagctcctttgagagcggaatcagcagctgtctcgctccttgaaggtttgaacgaaaataaacactgagctgcaataggagcttacgggttttttcaacatctgtacggcatagcgcagaaatcgtgttgatcgcattaaataaaaaatgcggattcacctgtgcttgaagcgctttaatttcagcatccttgagaagtttgctttgcagctctgcttccccaagctcaagctgtgtcgaaaacagcatggccagcccctcggcaagttcctcctctacctgactcaggcctgccgggcttttaaagtacatttttaaggtgccgattgtattgccgttcgatgtcagcggcaggacaattgcagcgtgcaaagggcattcagcatgcgtgcattcaatctcttcctgcgaaatcgccttcataatatgccctgttttaatcacctttttggacaggccggtgatcaagcttttcgatgggatgtggtgatccattcccgcaccgacatgcgcaaggatcttttctttgtcagtgagagacaccgcatctgttcctgtcagcttatggataatagccgctacacttttacaggagttttcatttaatccttggcgaaaaaatggaagtgtctgatcagcaatcgtcagcactcgatgcgtttcgagagcccttgcctgttcttccttgcgaatgatcgcttgaataatagacagaaaaataaaactgcctgttccattgatgagtatcatcggaattccgatcatgctgacaagctcccaggcgtcactgaacggctttgccatcagcaaaataatgatcatttgcagtgactccatgccgattcccacaagagcggcgatgcgcggtgtcggcattcgatatcgcttcgtaaaatacctgccgatcaagcctgcaagaacacccgctaaaatagatgagacggcacagcttaaggccgtgctgccaccgagtgaaaaacgatgcaggcccgcaagtatgccgatcccagcccctacaaaaggacctccgagaaggcccccgatttccacgcccaaaatacgggtattcgcgatagagcccgatggatctatcgtaaacacccagtcattgtttacaatcatatttctttgaatttcgatgcctgtataattgctgatgatgctgaaaagagaaaaaatagaaattaaaatcgcttttcctttatagccgtcctgattctgaagagcttgtctgaaaagtttcgtatgggcgagaatgaaccctaatataacaataatccccactctctccagcatcataatcattaaatgaatcattcatgtcacctgttctttccgttttcattctagcatgttttcgttttacggctgactgtttttttaaaatcgtctgaaaacatatttcacaaggcttttatctattgtaaaataaaacatgagccttttggcagaaagatttgaatctgaagcagaggagaagatcatgaaagccgtattttttgatttagatgatacactactttgggacgaaaaaagcgtcagaacaacatttgcagaaacttgcttacaggcggagaaaaaatatggccttgcccctgaggaattcgaagcagctgttcgcgaagcggcgagagaattgtacatgtcatatgagacgtatccatatacagtgatgatcggcattaacccgtttgaaggactgtggtccaatttctcagagccaatcagtgaaggctttcaaaagctgaacaagattgtgccggagtacagaagaaatgcatggacaaacggactgaaagcgcttgggatcgatgatcctgcatatggcgaatacttgggagagttttttgcggcagagcgcagaaaacgcccttttgtatatgatgaaacttttgctgtactcgatcaattaaaaggcaagtatgaattattgcttttgacaaatggcgatccgagtctgcaaaaggagaagcttgccggcgtgcctgagctcgctccttacttcaatgaaatcgtcatctcgggcgcattcggcaagggcaagccggatgtttcaatttttgaacactgccttaagctgatgaatattgaaaaagacgatgccatcatggtcggcgataatttgaatactgatattttaggcgcttcaagagccggaatcaaaaccgtttggatcaaccggacggataagaaaaacgaaactgacgtaacgcctgattacatcatcagcagccttcatgatttgtttcctatattagagaaataaaaaaagcatgatctcttcaatgagatcatgcttttttattttattttttcgcttcagctactgcctttttcacaaactcatcaagtgaaatggtttcagagttctgttctccgtatttacgcacgtttaccgctccgttttctgcttcttggtcaccgaccaccagcatgtacgggattttttgcatttgggcttcacggattttgtagccgattttttcatcgcggctgtcgacttcaacacgcaggccttcacgctgcaggcgttcctgcacttttttcgcgtagtctaaatgcacagccggagaaaccgggatgacttggaactgaaccggtgcaagccatgtcggcagcgcgcctttgtgttcttcgattaagaaggcaacaaagcgttccattgttgaaacgacacctctgtgaatgacaaccggacggtgctgcttgccgtcctcaccgatgtatgtcaggtcgaaacgttccggcaataagaaatcaagctgtaccgtagacagtgtttcttcttttccgatcgcagttttcacctgaacatcaagtttagggccgtagaatgccgcttcaccttctgcttcgtaatagtcgtggccgatttcgtccattgcctctttcagcatggattgcgctttgttccacatttcatcgtcatcaaaatatttctctgtatcttccggatcgcggtaagacagacggaatgtgtaatcacttaaaccgaagtcttcatatacatcctggattaaacggactgtgcggataaactcatccttaatttgatccgggcgcacaaagatgtgtgcatcatttaacgtcatcccacgtacgcgttgaagccctgacagcgcacctgacatttcatagcggtgcatcgttccaagctccgcaatacgaatcggaagctcgcggtaactgtgaatgtcttgtttgtaaatcatcatatggtgcgggcagttcatcggacgcaatacaagtgtttcattgtccatttccatcggagggaacatgccttcctgataatgatcccagtgtcctgatgtttcatacagctctttgctgcctagcacaggtgtgtatacgtgctcatagccgaggctgatttctttatcgacaatgtagcgctcgatgacgcggcggattgtcgcgccttttggcagccaaagcggcaggccttgtccgactttttgagagttcgcgaacagctttaattctttgccgagctttctgtggtcgcgttctttcgcttcttctagcatacgaagatgctcttcaagatcagcttttttgaagaaagctgtaccatatacgcgctgaagcatttggtttttgctgtcaccgcgccagtatgcgccagcaaggcttaacagcttaaactctttgatttttccggttgaaggaacatggacgccgcggcacaggtcaaagaattcgccttgctcatagatcgaaacggtttctccttcaggaatcgcatccaatagttcaagcttcaggtcgtcgccgatttccgcaaaacgggctttcgcttcttcacggctgacttcttttcgaacgatcggaaggttcgcattaacgatttttttcatttctttctcgattttcggcagatcctccggtgtaatcgcttcgtccatttcgacatcgtagtaaaacccgttttcgataaccggaccgacgccgaatttaacatccttgtagatgcgtttaatcgcttgagccagcaagtgagccgtactgtggcgcataatttgaagaccttcttctgagccttctgtaatgatttccactgtaccgtcttcattgatcggcgttctcaaatcgatttcttttccgttcagttttccggctaatgattttttctttaatcccggactgatggatgccgcgatatcttctgttgttgttcctttcgcaaactccttgactgctccatcaggaaatgtgatttttaccatatctgacatctttgtcactcctttttttgcatataaaaaccccgccccctatgaaagggacgaggttgaataaacggaatcgtggttccacccttttttccgcaaagccaatacacggcacctgcggctcttagctctgtaacgggagttcccgtcagccattactgttccttttcaagaggttcacagctgaagttcaaaggcggtaaagcgaatggtccttagctgggaagcttgcagccagggcttccctctctttgagccggtatcattccttcgtgtccttatcaatacgtgtgtctttcttaatctcctatgtattataaattgttcaatccaaaaaatcaacacgatcgcgtttccttttttaaaccgacagccttatatagacaggctgccggccctcacccttccgagtgcttcaccggtatttctgcatctgtaaaagcatgcagcgggagcatttccactctctcttgaaatacgttttgaatggtccttgccatcatgtgctcggctggtcggtataaagcacgacttcatcaggcgcaatggaaatcagcggcgcgagcaaatgagaatcaatatacataggatgatcccggacaaatctcctgtctatgtatttcattttttcccgttccgacacatagcgcagctcccataatgtaaaggaaccatcatggacaatatgcacttttttgattcgcggctgtttggcgtttacatagtctctgagtgtttgaataaagttttgatattcctgttccattttatattcatcaatcgctgcttctgtaatatctctcagctgcttatagtatgatccaagtcggaaggtctgaaaggagcgaatgtaaaatactccttcctctaaacagatcgtttggagttcatccaaaattgattgtttccgtgaaagcttcagcggctcaaacggaagatcgtctgcttcaccttcaataatactgtgtgcgagctgaaggatttgctgctgttcatcctgatccgtgaaacaatacgtttcctcaatcaatgacagcatatgctcgtcttctttgcattccaaaaaaaatttgaccagaatcggctccataaaacgctgaataggaaaagccggattcgctttttcaatcccgatttttcgtatgccttcacggacaatgatattgttccgatcgtccgaatgctgaatgagatgtaaaaaagcggctgcatcatggtcatcttcaaagattatttcaagcatgtttgtccccccttacggcatctgttacaagtatatgggggatgtttttaaaatagacgtaaaggtcattggcaaatcttaatttgattcctggaacaagttttgcattttctttctgaagataaatggcagcgagataaacacgatatatagagcgaggacaagtaagaaagctggcagattgccagtcaaaaagcttgctcccagcacattcagcgcaatcgtcccagggatgattcccacagccgttgccgcaaaatacggcagcgctttgacattggaaaggcctgccgcatagctgacgaaatcaaagttgatcggcaggattctcaaaagaaagatatagaaaaatccgttatcctccatttgcttctgtatggcttcaagcctttcgtaatgcccgttctttttcgccgaaaacaaaccggccgcaaaaaacgaaacagctgaagcgcacatcgaaccgaataacgtataaagcgtaccgagaagcgggccaaacgcaagtccgccagctattgaaataacagataccggaaataaaacaagtggcctgacgatggatatcccgataaacatcagaggtgcaaagactccgaacgacaatacccataccctgatttctttcggcgatacattcaaatattttttatttccccaaaagattaaacctgcacctgccagcactgccagccatttaaaagcggtttttcgtttcataccctcagttccttcccctttgaaccgcagcagttacggatggcggcggttttctccgtcaaggcggatcggagcagccaaatataatatccgctccattaatcttgccgcttttacttcttccttttcccccctttgcgaatacgtaaaatgatgcttcagctcgtcaggtgagaaattagaagaaaagaaagtaggcagctgctgggacattctgtgctgaagcaccgttccgatgacttcatcccttacccagcttgtcattgattctgctccgatgtcatcaagcatcaatacgggtgtggtctttaccatattgagcttctcttccaatgtctggtcttgcagcgaattcttaagctctctcacaaattcaggcacatagacaatcatggaagaatactctttttccgccagctcattggcaatcgcagcgagcataaacgtttttcctaccccgaatttcccgtataaatataatcctttcccttttcccgtctcattatagcttttcagaaagtctgtaacatgctgaaacatcgcgagcctgctcgggtcactgatatcaacttgctggaacgtcgctccgagaagatcctgctggatatacatgcttttcataagagacttttgtttcttctgctggtcgagcttccgtttgactggacattcataatactcgatatcaatagaccgcccactgacaacaagtttcggatggtagccctccaacaaattgttgcagttttcatcttccgaacaataggagcaattcttgctttgttcaatatattcataaagcttatttaagctcttttcgatcattttttggtcaatcacttcttcgttttccttcaaaaatgcttgaacatcttgatctttcatgactttttccttcatttgttcaagacgtttttggaaatccggcctgccggttacgccctgcagggaacggccgattggttccatctattccttcaccccgcatctctgtctttaataggcagagtattttttcagtttttgcatttcttccatcatctttttcttctgttcttccaaatcctgcggatgcagcttctgctgtccggattctgagtcagacgctgtttccttttctgtcatccaatcaggaagcttttcttcacgaatcactttttggtttcgtttcgaagactttgtttttccttcagcccattcaagatactggcggttttcttctattgcgagcttcatcgcttccctgaccgtttttacctttttgcgtgcccaatgcgaagcgattttttggatatagtttttggacagcttcatgtcggttttcagcatgacataataaattaacacatttgtgacgcctggctcgagcttctgttcgaacataatttcttctatgatcttcagatcagcttttgacggctctgttccgtcagcaatgtcctgcagaagcttcttcggggaaatcgcctcaagcaatgcaatcagcttcccatccagagaatcctcttctgccggtttttcgccttcacgcagatgcatcggctgtgttttttccaccaaatcgggcagctgtccgtttctttcaatttgataccagtcgctcgccgcttttcttaatgcctccgtcgtaatgacgtcacgctcatcaattgcgctcattacaacattttgcatttgcaaagggtcaattccgtacagataagaaagctttttgattgtgtcccgcacctgctgggtcatcgcttttctcggtatcatcgtctcagaaagtcccgctaaaaacaaatcaaaatcaaatacatcctccgttatggtgtaggatggagactgtccgacagaagtatactcggacccctcggcaagccttaccgtttcctccatatcggatgtgagcttccattcactcggctgcagcgattcaaacgcatgattaaacggacgcgtaatgtccttcgcatcttctgaaatggccgggtgcgtaaaaaattgttttaattgctgatatttcgtttttccgactctattatacagaaaaacattcagcattccgtcttcaaaaaattcattcggtctgagcggcggaaggagttcatatataaagaggcgctcctgccgctcggattctttcatatatactttcagcaatccgatgccctcgagcttcccctgttcctgatggatcgtttttaagttagactgtgtcatccccatcagctgtctatgtgtggactctccgccccacagacggttttgttcaagctctccccacaatgtcatataaagagagaatgcaacagggccgattaagggctggtacagttgtgtaataatttgtctgtcaatatcctgcagcatcgatctgcttttaaccacatacgggtctacaggcagtacatctttccaatagtcagccatacattctcaaaccttccgaatttgtttctacctttcattttacaccgtttcttatatctatcaaatgccaattttgcacatgagaaaagagctagaagaatcctcttagctcttttaacgctctttctttattaagtcttttaattcgtcgataaagacgtttatatctttaaactgccgatagacggacgcgaaccgcacatatgcgacttcgtcaatcttagccagccggtccatgaccatttctccgacgagctcactcttcacctcggagcagccttgattgcgaagctctttttcaatatcaaagcacatgtcttcaagcgttttgagtgaaacaggccttttttcacatgcttttatgaggccgcgcagcattttttctctgctgaattcctcacgcacaccttcttttttcacgacgatgagcggggtttcctccactttctcaaaggtcgtaaaccggtagtggcaggattcgcactcgcgtcttcggcgaatcgactttccgtcatccacaggccgtgaatcaaggactcgtgttccgttatgctggcatgaaggacatttcaataaaatcagctcccaactatatcgttccctgcaatgtattttcggcagcctccgccttttaaaaatagatgtgacagcatctgtcgggagagccgttgttaaatttgtttctatagcattaggtggtttgtgaaaatctccttcttattttacaaaaaaaataaaaaaagaaaaagctgacactctcgtttctttataaaaataaaaggagcataagctaaaaagcgcataatggctttctagcttcagctccctttgtgttcgcaatttactttatagtactttcgcttgcgcctgtttaatttgcacaggccccattcctcttggtatttcaatgttttctcttgtatcagcatgtaatgcctctgcaatgtaatcagcagcgacattaggatctaagtctccacaagtataaacatcaatgctcgcatatccgtgctcaggaaaactgtgaatcgttaagtgtgattcagaaataatcacaactccgcttacgccttgcggtgcaaatttgtgaaatgcaacctcgcgcacctcagcacctgattttagagcagcatttacaaacgttttttcaataaaatccatgtcattcagcttatcaaaatcgcatccccatagctcggagataacgtgacgccccattgtttccatagtcatggaccccccttaacaagaattaaaaagtgaaattccaacaactgggtcggccatttaccacggggaaagttagtccggagaggtcctaaccctttaagtaattccgaaacagtctcaagcaagaagttcacgaaaaatagtatactgtgtttaagtctaatttgcaaggtgcgttttttcagaaatatgctgttaagggttttttctttaaaatgtgtccatgaccttattttatacagcagacggatgtttcattcgtgccgctacatggcggatcagatcaacaactctgcaggagtagccccattcgttgtcataccacgccagcacctttactttcctgtcttccattaccattgttgtaagcccgtcaatgaccgctgaatgcggattcgtattataatcagtcgaaacgagcggttcatctgagtaatcaagtacaccgtacatcgacgttttggcagcgcgtttaaatgcctcgtttacttcttcagccgtaacatccgttttcagatcaacaacgagatcaaccaatgagacgttcggaacagggacacgcaaggcgaggccgtgaagttttcctttcagatgcggcagcacaagtgaaagcgcctttgccgctcctgttgtcgtcggaatgatggattcaccgcaagcccgcgcccggcgcaaatctttgtgcgggttatcaatatttttttggtcattcgtatacgcatgaactgtagtcatcagaccgctctcaatgccaaactcttcatccagcacttttacaacaggcgcaaggcagtttgtcgtgcatgacgcatttgaaataatgacgtggcgctcagcgtcaaattggtcctcatttacgcccatcacaatggtaacgtcttcattttttcccggagcggtcaaaatcactttttttgcgcctgcttctatatggcccatcgctttatctttagcattaaacttccctgttgcttcgacaactatgtcaatatcatattcccgccaaggcagctgttttggatcacggctgtttaacaaaagcactttctttccatttacgatcaggctgtcttcaccagccacaacctctttgtcgtatctgccgtgaattgtgtcatactttattaaatgagccagcgtttctgcggaatagctggcgttaatggccactacttgaatttgatcgtctaacatcgcttttctaaaaaccattcttccgattcttccaaacccgttgatcgctacttttaccttcatgttggacaccccttatcaattatgccatcctaatttgttactatctaaaattagtataacacattaaaacaaattcgccagtacatattgataaaaatcaacgattataacgctaatttatgatgcatcttatgttttcttgcacagaatatcaggcgtaagaaccaaaaagcagccagcgctccgcactgactgccctcatgctttatgattcctgttttaacttatcattgagcacactttcttctagcacagaaaatgtatccccgtacactctgttaatatgattcgctccccaagcacacagcatatctaaaattccttctaagctgcggccgtattcgctgagctcatattccactttgggaggaacttgattatatacgattcgtttaatgacaccgtccgcttccagctcgcgcagctgctgagtcagcattttttgcgtgatgttgggcattaggcgttttaattcgcttgtgcgtttttttccgtgcgtcagatggcataaaatgacgcatttccatttcccaccgatcacttcaagagtcgcttcaacagaaatgttatattttttcttctccatacaatccattctcctcacaggcaccaaaaagtgactatagcacttcaaagtacgtacttttatttcttaacgatatgtttcataatcacatttgccggctgatttgaatctgctcttttttatttatatagcttactcggcagaatttcaatcatacaacacatcttacaaaggaggaacatcatgacttcagccaataaaagcagtattcctgcactactggctttggccgtaagtgcattcgcaatagggacaactgaatttatcagtgtcggccttttgccgctcattgctgatgacctgcatattccagtcacgacagcaggattaaccgtttccctttatgcgctcggcgttacatttggggcacctatattaacttcattgacctcaagcatgtcacgtaagacactattgctttggatcatgtttatttttattgccggtaatacgatggcagcaaccgcttcaagcatcgggattttactagcagcacgtgtgatatcggcattttcgcacggtgtgtttatgtcgatcggttcgacaatcgcagcggaaattgtcccggaggataaaagggctagcgcgatttcaattatgtttaccggcctcactgtggcaactgtaaccggagttccttttgggacatttatcggccagcagttcggctggcgtttcgcctttatggtcattatcgccgtcggaatcattgctttcattacaaatggcattcttgtaccgtccaaattaagaaaagggacgaaaacaacgatgcgggatcaattgaagcttgtgacaaacagccggttattgcttttatttgtcattacagcgcttggatacggaggaacattcgttgtgttcacgtatctgtctcccctgcttcaggaagtaacaggcttcaaagccgggactgttgcagtgattctgctcggatacggaatagctatcgcgatcggcaatatgattggcggaaagctgtcaaaccgaaatccgattgccgctttattctatatgtttatcgtacaagcaatcgttctattcgtactgacatttacagccccctatcaagcagcagggctcattaccattctctgtatgggattgctggcctttatgaacgtgcccggccttcaggtgtatgtcgtcatgctggctgagcgttttgtcccgagtgcagttgacgtcgcatccgcgatgaatatcgctgcctttaatgcagggatcgcgcttgggtcataccttggcggtgtgatcaccgattcaatcggattgattcataccgcttggataggcggattaatggtggtcggtgcagtcattttaacaggctggagccgcttgatggaaaaacgagatcggcaggaagcctgacaattttaaaggaggaaatgaacatgacaacacatttacaagcaaaagcaacacttcataatggggtagaaatgccttggttcggccttggcgtgttccaagtggaagaaggatctgaactggtaaacgcagttaaaactgccattgttcacgggtaccgcagtattgatactgcagcaatctatggaaatgaagctggagtcggagaagggattcgggaaggcattgaagaagcaggcatttcaagagaggatctgtttatcacatcgaaagtatggaatgcggatttaggctacgaagaaacactcgccgcgtttgaaacaagtctgtccaaactcggtctggattatttggatctatacctcatccactggcctgtagaaggaaagtataaagaagcttggagagcgcttgaaacgctgtataaagaaggccgcatcaaagcgattggcgtaagcaacttccaaattcaccatcttgaagatctgatgacggcagctgaaattaagcctatgattaaccaagtggaatttcacccgcgcctcacacaaaaagagttgataagatactgccaaaatcagggcatccagatggaggcttggtcacctttaatgcagggacagctgctggatcaccctgtattggctgacatcgctcaaacatataataaatctgtcgcacaaattattttgcgctgggatctgcagcatggcatcattacgattcctaaatcaacgaaggaacaccgcattaaagaaaatgcaagcgtatttgactttgaattaacgcaggatgacatgaaccgaatcgatgcactgaatgaaaacttgcgcgtcggtcctgatccggacaactttgatttttaatggcaaaaaaacaccgttcaatatgaacggtgttttttgattatgcccagctgttcatgatttcatcaagctgccttttggtctcttcaagcgtgccgctgttatcaatgacttgatctgctcttgctgttttttcctctaagggcatttgagagcggatacggctgactgcttcttcttccgtcagctgattgcgcttcatcagacgttccagttgaagatcttttgtcacactgaccacaataattttatcaaccaatgattccaatttgctttcgaacaatagcgggatatccaatacaacaaatgcctcccgatttgcaacggcttcatcacggcgattgagcatttcctgcctgactgcgggatgaacaattgcatttaaagcgagacgtttttgttcatttgtaaataccagcgctccaagcttttttcgatctatatcgccatttgagagcagtatgtcttcaccgaattcgtcaatgatttgccggtaggccggcatccctttttctaccgcttgttttgcaatgatatctgcatctataactgttattcctttttcaatcagcatattggctaccgtgcttttgccgctagctattcctcccgttaaaccaatgactaaggtcaagagatccactcctttttacaatttccagagcccaatcgtgattaatagaagccccggcaaaaacgccattttatcgatccatttccacttagacagaaaatggccggcattgattccaattgatacaaacagcgagctcatgattgccacggcgatgctcatcacaatcggcgaaaaaccgagaatggctgcgcctatacccgctccaaaggcatcaatcgataaggcaaatcccaataagaccgcctcaattccgttgatcacacccgatttgtcgatatccgcactcatgggttttctcaaaatatgaatcacaattcctaatgaccgaacctctaaattaagcagtgttttttcatgcaataggtattctttatcttttgccggtttgaaaaattgatacagaacccacgcaccgattccaaccaatatcaaaccgccaagcttctccgtcacatatacaggaaaaaacttcgtgagaaagcttccgatcagcatggatataaacatgacagcaccggaacagcaggcgataaccaaaatcgctttaaacggtattttcatttttctcaatccgtacgtaaatccgactgaaaaactgtccaagctgacagccaacgccagcagcagtatagaaaccatttgcatatccgtttcttcctttctgttggtgctcttgtatcagatgtgaaatgcccgggattcatcacaatcatatatatgggaaagtgaaaaatccgtgtttcgaaaatggcatcctccattccagagttactgatatatgcaccgacagcttggacgatgaagcattatgctacttttttttctggcattttgcgcaaaaatgcgtgcctcttcctccaacgacaattttcgaaatcatcgttccgcaatttttgcatggctcgtctttttttccgtacacaaaatgctgcagctggaacattccgatttccccttgggagttgatataagaacggactgtgcttccgcccgcatcaatcgcctcctgcagagtgtttttgatttcagcgtgaagggttttgattgttttatctgataattgatttgcttttgtctcgggatggacacctgctctgaaaagagcctcatccacataaatgttcccgagtccaactaccgttttttgatccagtagggcagttttgacagcgcggtttgttttcgcaagccgttcttttaaatacgcacttgtaaattcttctgcatccggctccggacctaactgagaaagcgggagctcgcccgcttcttctcccggtttaaataagtgcatggttccaaatttccgcacatccctgtaccggagctgggttccatccgtcatcgtgaatatgacatgcacgtgtttatcgtcaggctcctcggcttgatgaagaccgtattttccttccattcgaaggtgagaaaccataacataatgatctaaatgaaacagtaaaaactttccccgtcttccgatggactgtatcgtttctcctgctagttttcgcgcaaattcctccggttcggcaggccgtttgatgatattcggccatctgatctctaccgatttgattgtttttccctttacaagcccggtcagagtgcgccggaccgtctcaacctctggtaattccggcacatccatcacttcctatctctgtttatttcgcatcgtaccaagatgggcctgatgcaaagtccacctttaacggcacatctaatgcaagcgcatgctccatcacttcaggaacaagcttttcaagaatttcaatttcttcctttggcgcctcaaaaatcaattcatcgtgtacttgaagcagaagccttgctttcaactgtttttctttcagcttggcagccatgtcaatcatggcttttttgataatatcagcggcgcttccttgaatcggcgtattcatggccgtccgctccgcaaaacttcggatattaaagttccggctcgtcagctcagggatgtagcggcggcgatgcataagcgttgttacgtatcctttttgtttcgcttcctgtactgaatcttccatgtacgcttttacgccttggaagctttccagatagcggtcgataaatgctcccgcttccttccgggtaatgccgaggttctgtgacagaccgtaatcgctgatcccgtaaacaatcccaaagttgaccgctttcgcctggcgtctcatcgcagatgtcacttcatccttagcgacatggaacacatccattgccgttttcgtgtgaatatccatatcatttgtaaaagcttcgatcagattttcatcctttgaaatatgggcaagcacccgcagctcgatttgtgaataatcggctgcaaaaatgagccagtctttttcagacggcacaaaagcttggcgaattttccgcccttcctcaagcctgatcggaatgttttgcaggttcggatcagtcgaactgagacggccagtttgcgttaaggcctggttaaatcgcgtgtgcactttatgcgaatccggtctcgtcacctttaaaagcccttcgatatatgttgattgaagcttgccgatttgtctgtactgtaaaatatagtcgacaatatcatgcttgtcagccagcttttcaagcacatcggcagacgtagaatagcctgttttcgttttctttacgacaggaaggccgatcttttcaaataagatgacgcctagctgtttcggagaattgatgttaaacggctctcccgcaatctcatggattttttcttcatattccttcagcttcgcacccagttcttcacccatccgttttaaacggtcaacatcgaccttgacgccagttgattccatttcgccaagaataagcgcaagaggcatttccagctcttcaaacagttcaagctggtcgttgttttccagctcctgaacgagcttttcccgaaggctttgaatcgctaacgcttttcggccaaggtgctcagacagtacgtcttctgacggcactgcccgttttgctccttttccataaactgattcatcacttgaaacgatatgcaggccgtaatccttagccacactcgcaacgtcgtcatatgaattgcccgggttgatgatataagccgcaaggagcgtatcaaactcggctcctttcagctcaatgccctgccagcgcaaagcgacaacagcccgcttgctgtcgaagacccatttcttctgatcgtcattttccacccattctttaaacacctcagactcaacggcaatgtctttcggaatgaaataagctcccgtttcatttacgatcgaaaatccgaggatcggctcttcatgataattatcgccaatctgttcaacgacaaatgcggatggagaaaccaatatatcgcttgtcacgtctgtgactgttttgacattaatgtcttccaacgattgatcctgttctgcttctgcactgccttctccaagccgttcaagaagcgtgttgaagccaagatctttaaagatggcaatgacctgttcacgattaaagccctgatattccaggccggaaacagatacctcaatcggagcatccgtcataattgtcgcaagctccttgctcatcaatgcctgatccttaaactcctcaagcttttccttcaatttctttccgctcacctcgtcaatggactctagcagcttttcaacggaatcaaattgttttaaaagcttaatcgcagtcttttctccgacgccgggcacacccggaatattatctgaggaatcgcccatcagacccttcatgtcaatgatttgttcaggcgtaagcccgtatttctctttgacatgctccggtgtgtaaaattcaacatcggtaattccctttctcgtaatggcaactgtcgttttgtccgttgccagctgggttaaatccttatctcctgagaaaaccttaacttcaaatccgtctttttcagccgatttggccagtgtgccgataatatcatccgcttcatattgttccagttcatagcggctgatctggtaggcatccagcagctcgcggataaacggcatttgttcggaaagctcaggcgggttttctgtctgccgcctttatattctttaaatgtgccgtgacgaaatgttgttttcccggcatcaaacgcaaccagcatgtgcgtcggtttttcatcctcaagcattttcatcaaaatcatcgcaaagccgtatacagcattcgtatgaacacctttatcattgcttaacagcggcaatgcaaaaaacgcccggtaagccagactgtttccgtctacaagcactaatttttttcgttccgtcattcaatttcctcctaagaagcctcaggcttccattcatctcttacatagtcattagctcctcttattttaacaaagttcaatttgaaaggaaaatacgtgaactataagagaagacacaaaaaaggacgggaacacaaataggttcccgccgtcaaaattggctccttggatgaaggggttctactacatcctaccagcataggtttaacagtgcatgaagatattgttaaacctttgtaaacattaggcggacttttcagcggcccgtttcagcgtcacggtaaagacagttccccgtccaagctcgcttgtgacatcaattttcccttcatgagcctctattaaatgcttgacaatcgcaaggcccagccctgttccgcccgaattcctgcttctgtctttatctacgcggtaaaagcgttcaaagatgcgcggaatttcttctttctgaattccgattccagaatcggcaacctcaatctgaatgtctttttctctgggttttacattgatagccacggagcccccctcaggcgtgtaggttaacgcattgtttacgagattaagaaatacctgtttcagcctgtacgggtcaccagatacatattgagggtctttcgggacattcaggtgcaaggagatgcctttctcatccgctttatgcttcagaagcgtttctatctcaccaagcattttggccggttcaaacgtttcgatactgagcgtgaaattttgctgctcgatttttgagagatcgagcaaatcctgaaccaaagactgaagcctttcgctttccttaagaataatagagagaaattcagaaagcgcctctttgtcctccatcgccccatccaataacgtctccgtaaacccttttatggacgtaatcggtgttttcagctcatgagaaacattggccacaaaatccttcctcatctgctctaatttctttgtttccgtcatgtcatggaaaacgagcacaattcctttccattcatcgtccggccccataatcggaacgccgtccacttcaaaataacgccgttctattttgatcggaagtcttaacagcttgcatttctttgtctccgtcataaaaatgtcttcgacaagctggatcacttcttcatgttcaaatgcatcgtgataaagacggcgcagcatatgattcggattgatatgaaactgcttggcgtaagatctgtttacgagattaataaagcctcttccgtcgatcataatcagcccggagccaatgttttcaatgactgtcagcagccgatcccgctgcatttcctgcgttcgcgtcatttccatcagatcaatggcaaggctgttcatcgcatgtcctagcttatcagaacgcctaatatagccgccgtacgtccgtgcatcgtagttgcccttagagagttctgtggctacatttgtcgctgactcaattgaccttttataacgtgaggtcatgctggaataaaaataaacaatgacgataaatgcggtacaaagactggccgtcagcatcccccacaattcgccttttaagccgtcgcttttttcagaggcggaaagcagcacatatcctgttttttcaccttcgcttctaagtgaaagtccgtaataaagcttgttatctgttgttgacagaataccctcatggccagaaacaagcgcctgcaccttttgggaatcagccgatctcccgtttgacccatacagcaccttgccgtctgtatcaataacggatgcgctcacatcaagcgcgccgcctgcatctttaatgattttctcatttgcttgattattcagattgccggcatcaagaagcgaagccaagtattttgcttctttttcaatgtgttcctctgctttcctttgatcagatgtttcaaaaagctgctgtaaaaacagcccgagaacacaaaacaccagaatcatacagacaacgaatatagaaaaaaggcgcacacggtatttattcattcatttttggctcctccagtttataccccaatcccctaatcgttttaatgtagatcggttttttggtattgttttcaattttgtcgcgaagatggctgatgtgcacatcaacaattctcgtatctccggcaaaatcataattccagactgcgctcagcagcaggtctcttgtcagaactctgcctttatgtctgcctaaatagagcagcagttcgaattctttcggtgtcagttcaagctgactttctttaaagtacgcttcataatgatcaggcaggattttcagatcgccgattacgatctggccttccatttcatcgttcttcatctcactagagggcgcagccatttccgaacgccttaaaatcgctttgactctcgcatttacttcccttggactgaacggcttggtcatataatcatcagcaccgagctcaagccctaatactttgtcgaattcctcatccttcgctgtcagcattaaaatgggaaacatcagtttttgctgtctcagctgcttgcatacttcgattccgtccaattttggaagcatcacatcaagcacaatcaaatcaggcttctctgtttccgcttttttgagtgcttcttccccatccgaggcggtaatgacatcatagcctgaccgttccaaattgtactgtaaaagagtaacaatagattcttcatcatccacaactaaaattttcttgttcatgctgtgcctccagtattataattccccgacatcctatttctctattttatgtcatcttaacatgtttcatgattttattttagcgaaagcaggacattccgacaattcgccttttacatcatttttaaaagaaataaagatgttcatgatagcgctttcatttatagtaaaaagagaaaggctgtattaagcaagcctttctctctttttattaggataatactttcatgacatttttgacagattcaactgatttattcagctgcgctctttcatagtctgtcagttcaagttcaatgatttgctcaagaccgttgccgcctacaattgtaggaacaccaaggtagatgccttcatagccgtattccccttcaagataagcaattgtaggaaggacgcggcgctgatccttcaagatcgcttcgaccatttctgtcagagaagccgcaggcgcataatacgcgcttccgtttccaagaagattcacgatttcgcctccgccttttctagtacgctccacaattgcgtcaatccgttctttcggaataagagtttcaagcgggataccgccagcataagaataacgcacaagcggaaccatatcgtcaccgtgtccgccgagtacgaaaccagtcacatctttcactgacaggtttaattcctctgccacaaatgttctgaatcttgccgtatcaagcacaccggactggccgattacacgctctttagggaagcctgattctttgtacaccgcgtatgtcattgcatcaacaggatttgtcagcaccacaataatagagtcaggagaatatttcacgatttcccgcgtaacgcttctcataatcttttcgtttgtagagaccagatcatctctgctcataccaggttttcttgcgataccggctgtaatgacaacaatgtcagagccagctgtatcctcgtaattagatgttcccgtaatttttgcgtcaaagccttgaactgggcttgcttcaagcatatcaagcgcttttccctttgtcgggttctccaattgcggaatgtcaacaagaacaacgtctgccagctctttttgagcgattaaaaatgcagttgtagctccggtaaaacctgctccgataacagaaacttttttacgagtatttcccatgtctctcttctcctttatggctagttttaggctttttccttgcttagtccatgtttttgatcagttcttctccgaactctgaacatttcacttcagtcgccccgtccattaatctagcaaaatcgtaagttacgactttggaagcgattgttttttccatagatttgataaccaaatcagccgcttcgttccatcctaaatgctcaagaagcagaacgcctgaaagaataactgaagatgggtttactttatcaaggcctgcatatttaggagccgttccgtgcgtcgcctcgaaaatcgcatgtcctgtttcgtagttgatgttcgctccaggagcaatgccgattccgccgacttgcgcagcaagagcatcagaaatgtaatctccgttcaagttcattgtcgcaacgacatcaaactcgtttggacgcgttaagatctgctgaaggaaaatgtcagcaatgctgtctttgataatgatttttcctgctgcttccgcttcgctttgcgctttgttggcagcgtcttttccttcttcttcagcaatgcggtcatattgagcccatgtgaagactttatctccgtattctttttcagcaagttcatagccccagtttttgaacgcgccttctgtgaacttcatgatgtttcctttgtgaacaagcgttacagatttgcggccatgctcgatcgcataatcaatggcagctctgaccaagcggcttgttccttcttctgaaacaggcttaatgccgatacctgatgtctcagggaaacggattttattgacgtttaactcattttgaaggaagctgataagcttttgcacttcttcagagccttttgcatactcgatgcctgcgtaaatatcttctgtattttcacggaagatgaccatatcagtatcttcagggcgttttaccggtgacggcactccagtaaagtatcttacaggtcttaagcagacgaataggtcaagctcttgtctgagcgctacgttcaaagaacggataccgccgccgacaggtgtcgttaacgggcctttaatcgcgatgaaatattcgcggatcacatctaatgtttcagcagggagccactcacctgttttattataagccttttctccggcgtaaacttctttccatgtaattttcttttcgcctttgtatgctttttctactgctgcttccaaaaccttcgaagccgcgttccaaatatcaggaccagttccgtctccttcgataaatgggataatcgggttgtttggtacgtttaatactccgttagagactgtaattttttcaccttgtgccacaataaaaacctcccagtatgtaattcatatttagaaaacattttatttttcttatatagaaaataaaatgatttttcctaacattcaatttaaagtgtaacccaattttgatgttctgaacaagaggctaacctcattgacgcaagccagcctccaatggttctttaggctctttcttcaatcggaacgaatttttgtttgtcagggcctgtgtaatctgcccgcgggcggatcagacggttgttgtcatactgctcaagaatatgagcgagccagccggacattctgcttacagcaaaaatcggtgtaaacaaatcatggtcaataccgaggctgtgatatacagaagccgaatagaaatcaacgttaggcggaagctttttctctgatgtgacgatgtcttctatacgaatcgacatctcataccatttgctttcgcctgtcaggttggtcaggcgcttgctcatttctttcagatgcttcgcgcgcggatcaccatgcttatacacacggtggccgaatcccatgattttttctttcttttcaagtttagcgcggatgtacggctcagcgttttccacttcaccgatttctgtcagcattttcataacgccttcattcgctccgccgtgaagaggccctttcagcgcgccgattgctgcagtaatgcctgaatagatgtcagaaagtgttgcgacgcagaccctcgctgtgaacgttgacgcgttcaactcatggtcagcatgtaaaatcaatgctttgttgaaggcttcaacttcaattggtgaaggctcttcaccgtttaatgtgtaaagaaaattctccgcaataccgtaatcttctctcggttcaacaggctcaagacccttgcgaattctggaaaacgctgcaaccaggccaggcacctttgcctgaaggcggatcgcctttctgtagttggcttccgggttcatggtatcagcctcgctgtcaagcaggcctagtaatgaaattgctgtccgaagagcagccatgggatgaacattttcgagggaataagatttgaagtgctcaataatttcttgcggaacggcagcttcctttgcaagctgctgctttaactcttcaagctcttttttgtttggcagccttagatgccaaagcaagtagatgatttcttcaaaacttgcattctctgtcaaatcatcgatatcataccccacatatgtaagggtatcatcaataatagaactaacagatgatgttgttgctacaaccccttcaagaccgcgtgtcgctgtcatatataacatctccttttcaataaatttcccctttaagagtgttgtaaaaacatgaggcttacttaaaaagcacgatgcaagtatttctctcccccaaaagaaaatgcttacattttactggctgctggaactaaaaccctttgcttatgaaagaacataacaaattcttataagcttatttaagtttaagcctattctcattataaacaataatcagacatttgttaaatgtttacctataattttttttttcattctgtgatttccccgaaaaaacgcctttatttgcgggtttttgcataaaaaaaaagcggctttcaggccgcttttttttatgaagtgaacagttttacgatctgcatggctaaataagcaatccccgctccgatcagcggccccaccgcaactcctccaaaaagcgcgactgcaagaatggtcccgatcacgagagcagttgtaatatgtggatcattttcaagcagggtcaggccgttttttgcaatcagcgccactgcgatccccgctccaagggcgatccatgcgtaggaagaccgcattgcttctccaagctgcttaaatccgatttctcccgtggcaatcgggacaagaacggcgatggtaataatggtcacaccccagttaataccttttgactggatggtcggaaataatttctgatcaagcccaacgattttgatgatcaaaaggacggatacagcaaagagcaatgattggttttttgcgataagtgcgatagccaagagtaaaattaaaaataaattcgcttgtgtaaacacatgccatccctcctttaagatgaatgtattcatattcagcaacagcgtgaatacatataaaaaataggacatgctgacgagaggaggaccgttttcgtgaatcaatcttatatcactatttttttcagaaccctctttgtcatatcaatgaccgcagggtcgatagctgcggcctattattcgtttccgttaacttatccgttcctgatcgcccttattctttcatcagtgattcatcctgttgtcgattatttggacaaagtgacaggattcccccgaacgataaatgttctgggcgttcttgctttttttctgctcgcagccttcggcgtccttaccattctggtagccgaaatcgtaacgggaacagcctatctagcaaaaacgctgcctccgcatatcagcacgtttatttcatattgcgaaaaattgtttacaacacatattcagccgctctataacgagttaactcttttgtttcaagaattggaaacgaaccagcaggcttccatcgtcactcatatccagacactcggtgattctgccgctaaaaatgccgggctcctgctgtcccacattctagagatgatcccgagatttttcgctcttcttcccaatacggcggcggttctgattttttctcttctggcaaccttttttatgacaaaggattggcataagctgaaagccatgcttgttttaattctgccggatcgtgtgacagctaacagcaaagcaatcagcagcgaattaaaaaaagcaatgactggttttatcaaagcacaagccgtcctcgttttcatcacgatggtgattgtatttatcggcctttctctcttaaaggttgaacacgccgcaacaattgcttttttaatcgggcttgtagatcttctcccttacttaggtgccggctccgtatttgtgccctggattttgtatttatcgattacgggccagctgccccaagcgatcggaattggtatcctgtacctcgtcgttcttattcagcggcagctgacagagcccaagatactaagtaaatctatcgggatagatccgctggcaacactcatcgccctgtttgctggctttaaattattcgggtttttaggactgattgcgggaccggctgtactcgtcatcatccaagctttcatcactacaggcgcattaaaagaaatatggtcctatatcaccgttcagcaaaaataaaacggcagccgtttttttcatggctgccgttttttatttgatgatgatccgcttattcttcgacattcctctcagccatttgaacagaatcggcttacaccagccgcgggtaaacgggataagaagacaggcgccggccaaatctgataaaaagcccggaagcatcagcaatagaccgccaatgaaaatgcacagaccgtcagcaatcgcttcccccggcattttgccatattgaagatcacgctgaaccttataatacacttcggttccttgtttttttgcagctgctgcgccgataatgcccgtcagaatcatgaatagaactgtcggtaaaatgccaatcagcttgcctaaaaataggaatatgccgatttctattgccggaaacacaataaaaagcaaaaacaaaaatctcatatccaagccccccacacgtgtaacacgttctgttcaacaaaaggcatgataaagagaaaaggaagggattccccttccgttttcacctgtaattaaagaacgctcgcacggccttgatagactgcacctctggaagcgtcaactgtaatatcctggccatctgtcaaaatagatgtcgcattttccagacccacgataaccgggatgccaaggcttaatccgactaccgccgcatggctagtcaaaccgccttcttctgtaataagagcagacgctttttcaagggatgtaatcatatcacggtcagtgcttttggtaacaagtaccgcaccgtcagtcattttttgctcagcttcttttgcattttgtgcaacgacaaccggaccgtaagctgatttgcgtccaatgccttggcctttagcgatgatatcaccgacagtatgaaccttcattaaattcgtagtgccggactcaccgacagtgcctgctgtaataacgataagatcgccgtgttttacaattccgctgttcaatgatttttggacagcatcctcaagcatctcatctgttgagctcgcattttggccgctttccgcgaatacgccagatacgagggcaagctttctggaaatagagtcatttacagtaaccgcaacaatcggagcctgcggacggtattttgcaatcatacgtgctgtatggccgctttctgtcggcgttacgatcgcagcagcattcaggttaatcgccgtatgcgcgacagattgtccaattgcgtctgtaattgtcatgcccacttgatctctgcgttttgagagaatttctttataatttaaagcttcttcagaacgggacgcgatgttatgcattgtttgaactgcttcaaccggatagcttccggcagcagtttcaccagatagcatgatcgcatctgttccgtcgaagatcgcgtttgcaacgtcacttgcttccgcacgagtcggacgcgggttgcgctgcatgctgtcaagcatttgtgtcgctgtaataacaggtttgcccagcgcgttgcattttttgatcagttctttttgcacaagcggcacttcttcagctggaatttccacacctaagtctccgcgtgcaaccattaagccgtcagacacttcgagaatcgcatcgatgttgtcaacgccctcttggttttcgattttagggatgatttgaatatcctgagcgttgtgctcttcaagaagctcacggatttcgagcacatccgtagaacgtcgaatgaaagatggtgcgatgaagtctactccttgctcaataccgaaaacgatgtctcgcgcatccttttcagtaatccccggaagattgacacttacgcccggtacgttaacaccttttttatttttgagtgttccgttgtttaatacttttgttttgatttcgcgtttagcggcatctacatcaagtacctcaagaccgataaggccgtcatctaacagaatcgttgaaccttgttcgacgtcatggactaaaccttcatatgtcactgaaattttatctgttgttcctacaacctcgtccattgaaataatgagctctttgcctgtttcaagctcaatacctccgttttccattgtatgtgtgcggatttcaggaccttttgtatcaagcagaattccaacgttcttgccaagttttttacttgcttcgcggatatttttaattcttgcaccatgctcctcaaaatctccgtgagaaaagtttaatcgagccacgttcattcctgactccattaatttcgtaagcatttcaatactttcacttgccggaccgatggtacaaacaattttagtttttctcatttggttcacttccttctgaaatcttcagccttcagctgcacattagatagacagttcttttgaaagctgatacatgttttgctcaactgtgtgttttgtctcaagtatttctataatatcatggtctacaagcttattgttttgtatacctacacagcgtccgccttttccttcaagcagcagttcaactgcatatgcgccgagacggcttgctaacacacggtcagcagcactcggagaacctccgcgctggatatggcccaatacagataccctagtttcaagatttgtttcttcttcaatgcgtttcccgaattcaacaccgctgcctacaccttcggcaacaataataatactgtgcttcttgccgcgttcgtggccgcgttttaagcgggcaatgatttcgtgcatgtcatagtctgcctcagggattaagatcgattccgcgccccctgcaagaccggcccacaatgcgatatcgccggcatgacgacccattacttcgattacatatgtacgttcatgagaagtcgctgtatcgcgaatcttatcaattgcgtcaattactgtatttaaagctgtatcgaaaccgattgtaaaatcagtgcccggaatgtcattatcaattgtacccggtacacctacacatggaaacccgtgttccgttaattttttcgcacccatatatgaaccgtctccgccgataacaacaaggccttcaataccaagcttcttcaagttttctatccctttttcacggccttcaactgttttgaattcaggacatcttgccgtataaagcttagttcctccacgatgtataatatcgcctactgatccgagttcaagcttttcaatctttccgctgatcaatcccgcgtatccgttgtaaataccgtaaacttcaacatcatgatagatcgcttttctgactactgcgcgaactgctgcgttcattcccggggaatccccgccgctcgttaatacccctatacgtttcattctccattcacctcagcaacatatatgattaaacataacatgatcattgccctaaaaacaatgaaaagggatctccatcctccctatgaaaccttacctattatacaattaaataaattgtttttaaataaaatttaaggaatgtcacaaaaaataaacgtgagccaaaggcttcacgtttatttagtttaccccgatatattgatcttcaaccgagactttgccaattgctttatatttttcatagcgctgctgaactaattcttcttcgctcagcttcagcaaagtttttaacgattgtttaagggtttcgtccatatagcttgcctgcagcttcacatcatggtgcgctccgccttttacttctttaatcatatgatctataatacctaattcttttaaatccggcgcagtgattttcattgtttctgctgcttttttagcaagactggagtccttccataaaagtgccgcggcaccttccggagaaataacagaataagtagagttttccagcatatgcaaatgattgcctacacccagaccaagggctccgccgcttccgccttcaccgatgacgatacagataacaggcactcgaaggccggccatctcaaacaggtttttggcaatagcttcactttgtcctctttcttcagctgctcgtccagggtatgcccccttcgtatcaataaaacagataatcggcctgttaaatttgtcagcctgtttcatcagacgaagcgcttttctgtagccttctggatgcggcatcccaaaattgcggactaggttttccttcgtgtctttgccgcgctgatgcccgattaccgttacagggaggccgtggaacttcgcaatcccgccgacaatggcttcatcgtccccgtacgctctgtctccgtgacattcaaaaaagtcggtaaacaggtgttcgatataatcaagagttgtcggacggtccgccagacgcgcgatttgaacccggtcccacggcttcaaatttttgtaaatatcatcctgaagcttagcgagacggtcttcgagccgttcgatttccgcacttagatccatatcggaatcttgggtgaatttttttagttcggcgattttggtttgcagttcaatcaccggtttttcaaattctaatcttggagccactcaatgtcacctcctgtttgatgcatatccagcagattttctaacgtttttttcatatcgtcgcgatgaataaccgcatcaagctgtccatgttttaataaaaattcagccgtttggaagtcctcaggcagtttttctcctattgtctgttcaataatccgtcttccggcaaagccgatcagcgcgccaggctcagcgaaattgtaatcgccaagggatgcaaagcttgctgatacgccccggtagtcggatgcgtcattactgaaataataagaccctgttcttcactgaacagttttaacgcagagcttgtcttagccatctgcatcaaacttaatacgccttcctgcattctagcgccgcctgaagccgtaaaaataataaacggaactttatcagcttttgctttttcaatcgcaagcgtgattttttcaccgacgactgaacccatgctgcccattctgaatgaagagtccatgacggcgactacagccgggtgtccgccgatggtgcccttgcctgtcacaacagcctcgtttaaggatgttttctcgcgatctttttcaagcttttccagatatcccgggaaaccaagcggattttccgagagcattccctgattgaattcctcaaaggatttttcatccatcaagctttcgatacgctgttttgcgttcattgggaaatgataatcgcagttcatgcatacccgcatatttttatccaactctttagtgagcatgatttttttacacttaggacattttgtcataatgccttccggaacatcgtgcttcgcttgatcagatggtacggaagcatactttttctttttcgtgaatatatcctttaacaaatgattacctcccttttgtgaagggttctcttcaccgcatgtcatcaaacagatagacttgctaataactttaccgaaactattgtactttttttgtcaaacgctgtcatcctcaattcgacaactttttattcgatgacgtgctcggaaaggcttgtatgaaatcagataaggtgttgaaacgacaaggttgacagcgcattcaaaaataatgttaaacccggctgaaatttttttaaggctaaccccctaaaaaaatttcagccgtcagtttaacttgagaacagcgcgccggtctccgccaacgcgctgccatttttggaatgaattaaaattattcaccaataatcgtaagttttcttgttttttctgcgacttcctcagggtcaacagtgattcttgcaacacctgtttccatcgcagcttttgccacagccttcgcaacagcaggcgcaacacgtttatcaaacggtgcagggatgacatagtctgcgctaagctcatcttctgaaaccagtgaagcaatggcttcaaccgctgcgattttcatttcctcgttaatatgagtggcacgcacatcaagcgctccgcggaaaataccagggaatgcaagaacattgtttacttggttcgggaagtcagaacggccagttccgataacgcttgcgccggcttcacgcgcatcttccggcatgatttccggatttggatttgccattgcaaagataattggatcttttgccatgctttgaaccatttcttttgttaacgcgcctgctacagagacaccgataaatacgtcagcatcaacgatgacatctttcagagaaccgtctttgcgatcttggttcgtgaacttcgccacttcatttttgacatcattcatgccgttcgggcgcccttcataaatggcccctttggaatcgcacatcacaatgtcgcgaacgccataatgatgaagaagcttgataatcgcaatgccagccgcacccgcgccgtttgcgacaactttaatggatgacatggattttccagacagtttcagcgcgttcacaagacctgctacggttacaatggcagtaccatgctgatcatcatggaaaaccgggatgtttgtttcttttttgaggcgctcttcaatgataaagcaatttggcgctgcaatatcttcaaggttgacgccgccaaatgtcggttccagcaattttacagtttcaacgattttatcaacatcgtttgtgtttaaagcaatcgggaacgcatctacgcccgcaaagcttttgaaaagaactgctttcccttccataacaggaagcgccgcttcagggccgatgtttccaaggccaagtacagctgtaccgtcagttacaactgctaccatgttccccttcattgtataatcatatactttgttaatgtcttcatgaatatccttacacggttctgcaacacccggagaatacgcgaggcttagatctttcgcatttctgacctctacttttgatttagactccagtttcccctggttgactttatgcaggtgtaatgcttcttctcttaatgacattctcctaaacactccttatggatattttttgattcgtatactgctgcgttgattgctgcattctgcggagtaaatctatctgaatatttaaacaggatcacataattgctccaattgtataacaaaaagcgaatcgttaccactgttttaaaacgacgtttttttgacccaacagctcttttaagcgatataacacctggtgatctgcattgatatggaacgactcaggtagcttaatcgtctgtttttgcctttcataatagagataaacgcctgtttcccctttatgctccagcaaaatgcgcttaatctttgccaggatctcctggctgtgctgactgctttctatttttatataaaccgatggcgctttttctgcatccatattttctaataattctgcccgggacatgatgaattggatcttatcttgtcttacttcgcatttccccgctgtgaacaaaagagcgccttctcttaaaacgggagaaagctgtctgaattgttcagggaagactacggcttctatctcgccggtttcatcactgagcgttaaaaacgccatgttttgacctgttttcgtccgaatcgttttgatcttcgacagcagaacgcctagtgaaagctgccttttgactgcccgctgagcctgcagaatagagactgctccttgcgcagtgagctgttttcggaaggcggagaggggatgatttgaaaaataaatgccgagcgtttccttttcaaacgcaagtaaatccaccagaggaagctcctccgtctccacatacttcggcttaattgaaaacgattcatctaaaaacaatcccatttggtcatcgtccgcggcgaatagctcagcatgttccaaagcaacatcaatggatgcgagcagcgtggcccggttttggccgaattcgtccatcgcaccagaaaagataagtgcttcaagcattttgcgatttacgctttttgacggcacgcgaaagcagaaatcgaaaagatcttcaaatggtttctcttttcttgctttatatatatctttgactgctgagacgcctacactttttattgcgcggaggctgtatctgacagatccgttttcaactgtaaacggaaaactgcttttattcactgacggaggaaggatacgaatcccgctcccctttgcttcgtaaagatattgagagattttatcctcattgccaatgacacttgtcagcaatccgcacataaaatataacggataatgagctttcaaatacgcaagctggcacccgatcatgctgtatgccaccgcatggcttcggttaaagccatagtttgcgaatttgacgattaaatcgtagacctcatttgcagtgtctacagaatactccttttttaagcacccttcaacaaaatggcttcgctctctgtccaggatttcttttttctttttgctgaccgcccttctcaataggtccgcttcgcctaaagaaaaccccgccatacgggaagcaatcatcataatttgttcctgatacacaatgacgccatatgtatcttccaaaatgctccttaaatcttcatgaggatagtgaacaggctcccggccgtgtttacggtcgataaataacggaatattttccatcggacccggccggtacagtgcattgaccgccacaatatcttctaggcccgaaggtttcagccgtttcaagacgcttctcatccctgcagattcaagctggaaaatgcctgtcgtatccccttttgacagcaaggagaacgttttgtcatcgctgtaggaaatacttgaaagatctattttaatattttcttctttttcaatcattgaagtgatggattcaataagtgtcagattcctcaaacctaagaaatccatttttaaaaggcccaagtcttcaagatggtccatcgcgtattgcgttaaatagatcccttcatgcccttcttgaagcggaacaacatctgttaagggttcttcactcaggacaacgcccgctgcgtgggttgatgcatgccttggcagcccttctattttccgggcaattgaatagacttgctgaagcaggcttgactcccgaagccgcttatccagctgcggtgactgctgtctcgcttcatccagcgtcatgcccggtcttgaaggaatgagttttgcaagctgatctgcctccttcgggctgacgccgaatactctgccgacgtcccggagcgccgcctttgccgcaagtgttccaaaggtgataatctgtgcgacgtgcattgcaccgtatttctgctgaacatattgaatgacttcatcccttctagtatcgggaaagtcaatatcaatatccggcatgctgacgcgctcgggatttaaaaatctttcaaacagaaggtgattcttaatcgggtcaacatctgtgatatacagcacatatgccacaagagaacctgccgcagaaccccttcccggtcctgtaacaatccctttttcatgggcgtgcttcataaaatcccacacgatcagaaagtaatcgctgaacttcatccgcttgatgacatcaagctcatattgaagacggcgaaggtatcgttcattaggcttgccgaaacggctgcggagtccctccatacagatatccgttaaataatcatcagcggacgttccgtctggggtcggaaaagacggtagacgggtctgcccgagactgacgtcaacccggcattgttcggcgatctctacagaagcttgcagtgcctcgggatgctctcgataaatgttttgcatttcttcgagtggtttcaaatcgagatcaggcaaatcttcagcgggtgcatccgtcagtttttccccgctttaatcgctttcaaacaacggtaggcagccttatcttccttccttatgtaatgcacatcgcctgtggccgtaacagggatacccgtttcttctgacagctttagaatctgctcagacaagacttgattccctttaaaaggctgataggagaaataaaaagctccctttccgaatatagactgaaattccagcgaggcttgagcagcctgttcgaacagccctccttcaagaagcgtttcaatatatcctttttcgccgggcgttattgcgataatcccttctcgataactgtgaagccatttcggcttcagtccgccttttgatttagattgcagaacgctgctgattttcagcaggttttgatagcctgtatttgattttgccagcaggacgagcgggtatgcttcaagctcgctgtcatccgtaaaaacagaagccgtcaaaccgattattgggttgatccctctcgccttgcaagctttataaaattgaatagctccgtacatgacatgatcatctgtcagcgccaaagacgcatatccgagcctgtcagcttcactgacgagctcttccacagccgcggcgctgtttagcaggctgtacccgctatgcacttgcaggtgaacaaaagacatgctatcacctctttctcattacgatccatttcttccttcattataaggccggtttccaaaagaaacaaatgttcttttttgactcatcatcatacttgtcctgaaagctcaatatgatataaaaggtgaggtgataaagatggatcaggaagcaggatttatggtgaattttatcaatagctacttcattgcgttaggggtgctgatcgggggcgcactcatcggagggctcggagcatatttggcaggcgaacccccgcttacagccattacaaagcttgccaaccggttaaaaatatgggcgcttgtcgcagctatcggaggcacctttgatgcggtatacagctttgaacgcggcatactcgaaggcaatacgagagatatctttaaacagcttcttttaattatttcggccatggggggcgcgcaaagcggctggcttattatatcatggctgacccaggagcatctttcttcatgagggtcccccagcattacaaaaaaccgggatggcagcgttttttcgcgggaatgatgtgcggagccgtaattagctggttctttttcctgtttacttacggaacattccaagaggagcaggtcagcctcatcgaaaagcaaaaagagcatgtaaaagacttgaacaatcaaatttcgatctatcaggaagacctccataaactgaatgaagataataaaagaaaactgctgattcaaagcgtcagcgtcaaattgctgaatggggataaatataaaatatcacagccggataaaacgaaattcgaggagcatgtaaaggatgatatttcagaggtgattacaaaagacatagagagtgtctatcaaacaaaggatctcttgaagcggacaattgaaaataaagtctatatgatcaatgaaaaaaaatacgaggcaaccgtcagagaattgattatttatacgaggctgacagtggaacttgaaatatctttcgccacataattatggattttttttaaattctccaaacttctgtcgctttttcccattcttttttataaactatatgtgaggcttaatggcgaaaggaaggaggaagggaaatggaggtttacagtgaccgtcagttagcaaaagatcaagcagcccgtctcagacaaggtttttctgcatatgccgaaacaaactcactcgcttccctcatcaaaaaagaacttcaatcacacaatctccaagtctacgaggaccttactgatttcggctgctggttcatccccgtcacagatgaacactaagagagagggtctcccctctactcgtgttctttacataatgtttccagatcagctaaaatccgatcagcttcatcccagctgtaaatagaggcgcctgaagctaacggatgccctccgccgttatatttccgggcaagtccgttaatgacaggccccttcgaacggaatctgactctgatttgatcgtcttcttctacgaaaaacacccaggcgcgaatacctgagatattgccgagcgtcccgacaagctgtgacgcttcagaagccgttgtgccgaatttttcaagcgtatcctttttgatgaaaacagaagccgccccgttttcggacaaagacacattttgaaagataaagccgttaagcttcaccacattcagttttgtttcatacaattgattaaataactctgaggaagagaatggatactgaatgagctcgcctgcatattttaatgttttttccgtggtattcggaaataaaaagcgtccggtatctccaacaatgccggcgtagatcagctctgccgctttcgtattcagcttccagccgtgctcttttccttctaaatacagctcgtaaatcatttcacttactgagctggcgcttgtatcgacccagagaaggtcaccgtatggatcttcgttcggatggtggtcgattttcattagtttggcgcctgaaggataacgctgatcgtcgattctttcctgatttgccgtatcgcagacaatgacaagtgcgccttcatatgtttcattgtccacctcatcaagggaatataagaaagagagggacggttcaggcgtgccgaccgcaaaaatatttttttcaggatatgtttcacgcaggatttccgtaagcccgcactgtgatccgtaggcatccggatcaggacgcacatgtctatgtaagataatcgtgtcatataatgatatggttctgatcaattctgttttcatttgatactcctttattgtttttattcattaaatcacattctctgccgacggaaaagaaaaataacgtcaaaaccaagcccgtttttgtataaaatgggtttgtaaacttttacgatggaggatttcatttatgctggttcttgtttttttgattgggctttccgcctgcttttatgtgtactataaagtaaaaggcgtacgggcaaagccatctttggcaaaagaaatatgttcagcaaaatcaagcatggccttagggtcactagtcctgttctacgggctcaaccaaatgatattattccattcagtattaacgttagtaatcggcggtatctttatcgtcataggagcaggaagcgcttgggcaggttataaagccttcaggcattacaatccccttcacgccaaagaagctgaaagagatcacgcgtaaggggcgcctgaacgtcccttagcttctttccatcagctgaaccatcagcatcgctttagacacgatatgaccttggctgtgcacttccacttccattttcccaaactttctgccagcctccaagatgcgaggtttgacttcgatgactgattccatctgcacaggcttcaaaaagaagatggtgatgctctctatgacgagttcgccgcgttttttcgagcgcaaaaatcggtttgccgcttgcgtcaaaatggtcgtaaatacgccataagaaatggttccaagctgatttgtcatttgcggcgtgacttcatactcgtaaaccgtttgattttctttatcatcaccctcatctttaaacccccttgaaacgatatcatcaagcttctccccgacctgtggctgcttttgaatcatttgaagagctttcaatacgtcttggcggctgatcatgccgatgagtttttggtggccgtcagtgacgggaagcacttcgatcccttcccataccatcatttgcgcagctgaagcgacagatgttttcccaataaccgtgactggatttttggtcataactttttctatagatgcatttcggtcatggccggcaatatcttttgatgtcagaatgccatggattttcatttgatcgtcgacaaccgggaagcggccgtggccggtttcaaaatttttctcataccatttttcaagtttatccttaggcgaaagatataccgtgcggtcagcaggtgttaggatgtcctccaccaaaacaatttcttttttgatcagctggtcataaattgcccggttaatcatcgctgcgactgtaaaggtgtcatagctcgtggataaaatcggcagttcaagctcatctgccagctgcacaatgctgtcatccgtgttaaagccccggtcaccaatacggccgcgcccgcttcaagcgcctgcctgtgtgcattgattctatttccgacaatcaaaagattccccgctgcggtgtaacgcatcatcgcgtcaagctccatcgcgccgatgacgaatttattcaatgtcttatggagccctgccctgcctccgagcacttgtccgtctataacatttacaacctctgcataggtaagcttttcaatgttctcttttttcttttgttcaattctgattgtgcccacacgttcaattgtgctgacaaaccctttattctctgcttccttgatcgctctgtacgcggttccttcgcttactttcatttcctttgcaattcttcggacagaaattttttcaccgacaggcagtgaatcgatatacgttaaaatttgttcatgcttcgttgccaagcctttcacctctaaggacagtcttcttgtttttattataaggtttcaaaggatttatacgcaatgaggctggaaaataaaaaagaagcccgaccggcttcttacagcgttgatttcgttccagtcaagcgcaaggaccccgtggctccttttacatcgtaaagcggaaaaaaccctttatttttcttttaaatggacatcaaccgctgtcttaacaatatttcgattccctattttagataaaacaaataaaactgcgaatagccatatcgcccctatgaccgtatagatcaatggataaacagctgtgtttgtgatccattcacttattaatgttctggcatttaccagaataataaatcctcctacaagcacacccatcaattggggatgaaacttctgcaccagccatgctgcgataggggcagcgataattccgccggccattagtgaaaacacccataaccaattgacgtcctcccatcctaatgaaataagaaaaccggcagttgcagataccgcgatggcaaattcacttgtgtctacagtcccgacaactttcctcgggctcaagcctttgcgggataataaaatcggagtggtcaccggtccccagccgcctccgcctgtggcatctgcaaaaccagcgatcacgcccaatgggatggattgttttcggtttaacggcacatgcttcttctcaagagccggcttatattgaaataaaaacctgatcaatacatatccgcccagaaggagcaaaaacaaagaaatatagggtttcgccacatctccaggtaattggctgaggaatgccgcgcctaaaaaagcgcctatagagccgggaatgacaagctgataaacggtttgtttgtcaacattgccaaatttaatatgcgacactcccgatgcggcagtcgttacgacttccgctaaatggacagaagccgaagccacagcaggtgtgatgccaaacgccaataacaaagaagttgaggtaaccccataagccatacctaacgaaccgtctattaactgcgacaataaaccaataaatgcaaaaacgattaatttcttcatcagaacaccccatctatatcaatcagatatttttgactcttcattcgaatctaacaatctcttggcgctttcatataaaaaataagaggctttgataatggcagtttcatcaattgtaaatgcagggtggtgccaatcatgatcaccgtctgttccaaaaaacgcaaagaatcccggaatatgctcaagataataagcaaaatcttccccgcggttgatggggcgggatcaatgacttgaagtttcgctttatgtgcagcgtctcgcaccagccccgtaattgcctcatcattacaaagcggcggcggtccggaatgccacttcacatttgcctttaacgagaaagcagcagaaatctgctctgtgactgccaaaaaacgctgtttcacttgattacgaacctctgaatcaaatgtacgaacagtgccctcaatgacaactgtatccggaatgacattccaagtgctgccgccgttgattttccctacggttaaaatcgcgctttgcagcgggtttacatttctgctcacaatcgtttgcagggcgacgataagctgagagccgccgacaattggatcaaaaccattatgcggcaatgctgcatgagctcctttcccttctatctctactttaaatcggtcaacagcagccataagcgggcctgtttttaaccctacagtcccaaccgcgatatccggtttattgtgaaggccaataaccgcatcaatgccatccagttggccgtcctctatcacttttgcagcgcctgcacccgcttcctctgccggctgaaataataaacgaatctttcctttcagactgtcttgattttccttcaataaaaaggccgcaccaagaagcgctgccgtatgaaaatcatgaccgcacgcatgcatgatccctttatgtttagacgcataaggcaatcctgttttttcttcaattggcaaggcgtcaatatcagccctcaaagcaatcgccggaccttctgactcccctgctatgtctgcgaacacacccgtttttagagcagtagggcgaatctgtacccccttttctttaaggcatttttttataaaagcagttgtttcaaattcttcttttgacagttcaggatattggtgcaggtgccggcgaatgccgatgagctgcttttctagcgttgagagatttacgggattagactcctctttcaacgtcaggatgtcatttcctgtagtctgatatggataggagccttctatatttctccaataatccaaagacatatgttccgctcctttccctatcccaatatattttcttcagactcttcaacataagatgaaataaatcggttcaatttatcagcaagaccacccgccccaaatcttatatacttgctggaaactttcggattatcctctttcaaaaagcttaaaaaagataaaatataaatgcgcctgtaaactacttgtgtaattccgtactcaaaaaaccagttatcaatgacattgtatacgcctcggttgacgccatataggttgttacatttcttgtaaaagcagagatccggaagatttaactcctgatgggaaagcaggctttcttttttgttcggtgccataattccaatcagctcaaagcgttttgcagcgcacgaaatatcctttttaatttgctttgttaacgactccaaagaatcaaaccttctttcttctctaattttaaagagaatgctgcattcgattttttctccataaatgtctctatgaaagtcaaacaaaaaaatctccaatgtcttttcaaggttagagcccaccgtcggtttcacaccgatattcataacccctaaatgaaattgatgattgactgtcgccagaaccccataaactccattacgcagcccatgcatttttgcatctacatttgccgtggggaatccaagttttctgcctaattgttttcctttcacaaccgtaccggcaatgatcgtcaaaaaagtcagcctcccctctcagcttccgcattcgatcagacgaaacctaatgatgtgatgaatgtaaaacggattgatgctgcggaatgccaagaccgagattttcccgcaatgtcccgccgcgataatcttgacgataaagccctctttcttgaagaatcggaatcaccttttctacaaaagcatcaagtgttcccggtatatccgacccaatgataaacccatccgccgcctcagcgttgaaccaagtttcaattaaggatgcgacacgctctggtgttccgatgaatagagtccgtggaaaagccatttcctgtgctacctcccgcaatgtcagatttctggcttttgcttctctcttaatccggtctgttgtgctttgaaacgcattctttcccacatcgccaatatcgggaaatggctcatccaacgggtaaacactcagatcataatcatcaaaaaaacgggccaaataagtaacagcattttcaatcggtatcaattctgcaaattcacgatacttcttttccgcctcttcttccgtatctgccacaatcgggctgatccctggaaaaatccgcacacttgaaggatcacgcccttcatcagcagctcgccttttcacatccgcataaaacgcttttgtctcttctaatgaattggaatgggtaaaaatcgcatccgcatttttagcagcaaactgccggcctgtttctgatgaacccgcttgaaacactacaggctctccctgcttagagcgcccgatattcaagggcccctctacttgaaaatactttcctttatgattcaggcgatgaagcttcgccggatcgaaaaactgccctgttttcttattgtgtataaatgcgtcatgctcccaggaattccacagcccgcgcacaacatccaaatgctcttgtgcgatctcgtaacgttcagtgtgttctggcaaattagacttactatggttgcgcgccgctccttcctgtggagaagtaacaagattccagccagccctgcccccgctgatatggtccagcgacatcaattgtctggagatagtgaatggctcagtaaaagatgtagagaacgtccctactaaaccaatatttttggtaaccgatgccagcgcagataaaatggtgatcggttcaaaacggtttaaaaaatgaggaatcgatttttcagaaataaataagccgtctgcaatgaaaataaaactaaacaaacctttttcagctgtttgcgcctttttcatgtaaaattcaatattcgtgctggccgagggatcaacatcgggatgacgccagccgtcagttgttcccccgacaccgtgaatcatggctccaaactgaataaaatctgaacgtgtcatctttttgcctcctttatctgtgcatgattagcaagtgcaagatcaaggtgttcaatgccgatttcagttatcccttgatactgattgccgcgcccgatttcgaccacaggcacatggcgcaccccatatttcacctgtaaaatatcccgaagcttttctttctctgaaacatcgatattttggaacgggaaccttttttcattcaaataattcttgacttcctcacaatacgaacagccttttttactccaaaccacaatgttcaaaacatcactcattcttctgtccctccttaacgttttgcagctaaaactgcatcgctcagcagctgataagacagctgtttttcttcagcatttttgatcggtgtaaaaataacaaaatcattgattttgtatgtgcctgataaacgtgttaattcttctgccacttcttcctttgttccggcaataatcccggttttttgcacgatgatgtcatagggctctgtgacgttttccagataagcctcagcctgttcgcgggaaccgacgttgaccttacgcccgtctttcaaaatcacttttatcgattcacgcgacacaatatgtttttccgcttcttcttttgtatgtgccgcaaaaacagcgggagcaagatgaaattcagcctcagatcctgggggagatgcgcgtcaaatgctcggcgggcttccttcagcacttcctcttcaccgttaataaagtaagcaaagacaaaagagattcccagttttgcagccgaaatggcactctctgtgcttcctcctaatagaaaaatacccggctcccgatcaacctgcggcctaggacgcaatgctgcatagcggtgggtatcaggaaaatcatcccgtacgaaatgagtaagctcctccagtttttcatcaaactgacgcaccggtttttcataatcggcctgcagtgcgtctgtggacagctgaaacccgccgggcgctttgcccactccaagatctatacggccgggagctaacgctgatagaagatggaattgctccgctactttataagagctgtaatgctgcagcatcactccgcctgatgctaaacgaatttttcttgtgcttgcagcaagatagcctaaaagaacctcgggtgcagaccctgcaatctcatcattgttgtgatgttcggccacccaaaatcggtgatatccacactcttcagccatttgtgccaagttcactgtatgctgtaatgtatcagctgctgtctccccttcaccaatcaagctttggtctaaaatacttaagcggatcatatcaccggctcctttatgtgttcttttggttcaaataaatattccggcgaaacacggcggagaaactgcctcgttctgtcttttttggtatggcggaagacttcctccggggttccttgttcaacaatgactccttcatccataaaaacaacttgatcagagacccttcttgcaaactccatttcatgtgtaacaacaatcatggtggctccggttttcacgatttccagcattacctcaagcacttcaccgaccagctccgggtcaagcgctgccgtcggctcatcgaacagcagcacatcaggatgaatggcaagcgcccttgctatcccaaccctttgcttttgtcctcccgataactgactcggataagcgttcaatttatcttgaagcccgacctttctcagttcattttccgctacggcatacgcgtcttgctttctcattttccgggcaatcgtcaagccctccatgacattttcaattaccgttttgtgagcaaacaggtggtattgctgaaataccattgccgtctgttttctgagccagtgaacctcttttttcgacggaaagctgcaattaatcactttgtcatgtatagaaatgatcccttcgtctggacgttctaataaattcaggcaccgtaaaaaggtggttttccctgatccgctcggcccgataatcgtcacaacttctcccttgcgtaccgtgagatttatcccttttaatacatggtggatgccaaactgtttatggatatttttaatctcaatcataaagtgcctccttgaaatctggctgcctttctctctaatactccatttacggattctaggattagagtcagcacccaatagataatcgctgctccgataaacgcttctaaaaatgcataattatcagaagcaacgatagtcgccgtccctgtaatctctgggacagccactatagccgcgatagaggtggtatgcaaaaagccgatacccaaatttgtgaagtttgggatggaaaccatcagcgcctgcggcaatattacacgccgaaaggtttggctgtgtgtcaagccgattgaataagccgcttcgacctgtccggtatccatcgccagaatgcccgaccggatgatttctgtgagataagctccggcagttaaagacaaggccatgatgacaaacatggagaccggtatctcattggcggaccagccgagatgaaaaaaactgctgacttgatctgcaacaggcggtatccctaaataaatcaacataatgtgaaggattgcaggtgtacttcgaaagaaagacacataaaaccttgagcaagccaccaagcccttaattctaaaaattctaacaattatatttccaagagccacgagaaatccaaacacaatcggcaaaacagccatcatcaatgtcagaggaatggtctttaccatttctttcatggcggaaacgataaatggaaagtcaaattgcaatcttctcccccctcatccgaagaaatatatcaatgtatgttcatgtcaaaaacagtaacaatccttgtttgattcttcttgattcgtttttctgccactcgaaagaaccattcgaataaaactgcaacagcataataaacaatcgatagcgcaatgtaaacttcaagagaatggttgcttgaggtaatcagtgtttggccccttccggacatatccataacacctattgaaaaagctagagatgtatcttttaaagaactgatcaccatgtttcccatattcggaaacgcctggacaagtgcctggggcagaacgattcgcctgaaggcctgactaccgcttaagccaatactgtacgccgcttccgtttggcctttatctacactgcccacccccgctcgaatgatttctgcggctgccgctgcattgcttaacgcgtaggttgcgacagcagcataaaacgggtccatttttgatgtatcaatcccgataagccccgtaagcaccgggattccgtaaaacacgatgaaaagctgcaccatgataggcgttcccctgaaaaatgagatatacacttttgccaattgatttacaattggaatattgtagatgcggggcagtgccagaaagagtcctaatacaaaaccgaaaagcaaggacagtgttaaaatgtataatgtaaccggtaaataagcggttaacgtcggcacaaaatctccaatcatgttcatatcaaacgctttttccatcactgctccctctctttttacctaatactgctctttggaatagtcgtcaccaagccatttcaaactgagccttttcagcgttccgtcatcaatgatttcctgtaaggctttatcaatatcgtcacttaacgtttgttcatttttgttaaacataaaatacactttggcatttgaaagcacattaccgacggttttttctttaatagcgctcgtcttgttttgaaagtctactgcaaaaggcgttgagatcgttgcgtccgcacgccccgatttcagctgattcgcagtctcatttgcgccttggccctcataggcaatctcaaacggccgtccattatcctcattccattttttcagtacaagcgctccgttggaggttgcactcgtaatcacccgttttccttttaagtcttcaattccacggatcgtatcgttattttgaagcacagtaatttttaaaggaaaatggttgtaagcaaccttgttaaacagaaattttttctcacgctctttgcttttctccatttgatgtgccacgatatcgactttatgctgtccgaggctgacaagcaggttggaaaattccatcgttttaaatgtgaatttataatgtggcaggcgcttatcaagctctttgatcagttcgacatcataaccggttaaatcgcctttttcatcgataaagcaaatattcggaaattgggttccagttccgaccgtgatcgtctgtaccttcttttgcccggctcccgtcgtttgactgcctgcaccgcaagctgacagaactgttataagcgaaaataatattgtcatgaatgctgctttcgttttcatctcatcgccccatttatttttcaaaacttgattttgaataatctgccccgagccattttcggcttagtttttttagcgttccgtttttctccagctttttaatcgcttgatccgtgtcatccgccaaggtttggctgcctttattaaacataaagtacacctcggtatctaataacacgtcaccgactgtcttttggcggaaggcgtgcgttttattctgaaaatcgacggcaaacggtgtagctatcgttgcatctgcgcgcccggtttcaatttgattggcggtgtcattgcttccctgtcccgcatatttcaaatgaattgggctgccgtgcgttttgttgtactttgtaatataatctgccgcatttgacgtggcgccaactatgactgtttttccgtgtaagtcttttaatgtatgaatcttgtgattatcctctttcaccgtgatgtacatcggcgagtagttatatgggactttatgatacaaaaaacgcttttctcgttctttatttttggccatattgtgcgcaatcacatcaatttttttatttccgagactcgtcagcaaatttgagaaatccatcgttttaaattcaaatgtatattgaggcaactccttatcgatggctttcatcacttcaatgtcatacccggtcaaatcgcctttttcatttaaaaacgcaatattcggaaaatctgttccagtgccgactatgactgtttgagcctgacgatctgttttgttatttgtttgcgaacatcccccgccaagtaatgctaacactgacagcagcaaaaccaatcctttacgcttattcataggctcctcacatcatgcccagctgggcgcacctaaaagcgttgggttaaatcgttccggaatcagaaccttgtgcatcatcacacctatgtccccgtctttttcctgctcaaaatacacttcataccctctccttctgtacatgtcagcaagccaaggatgcttgcgcgcggatgtgccgagtgtcagcgcaggagccttcagcatatctcgaagcactttttcttcaacatacgtaagcagcttacttccggcgccttgccctttatattccggcagtgtcgcaaaccaccacacaaatggatattttgaaggaggcgtctcactctcccacgggaacctgattgtaatcgttgaaatcagcttcccatcccgctccagcacaatcgctgaatgatgttcaatattttctgataccatttggatatcagctctcgtggatggccaatcaatatccagctgccgaatgggctgaaatgcgctgttaaccagtttcaacagctccgatgcatcttcaacagttgccagtcgaaaaatatcatcactcatttttgtcactcctcttcacaaaatatataattcctatttgtttactaagcttttattgtttatactataaagcatactctgatctttgactaatcaaaaaaagtaaaccttcacttcagtaattttaatgatgaaaaacaggagggagcacattggagttacgctcaatcaaaacgtttcatacgattgtaaaatttggaagcttctataaagctgcagaaatactcaactactcgcagccgacgatatcgatgcgtatgaagcaattggagcaagatttaggcgtactgctgtttgaaagaggaaaaagcctgcagttgacaaaagcagggaaacttttttatgaacgaacaggagatcttttgatgcaatacgaggcgcttaaacacaatctctccgacttaaaggaagaagaggcaggcattatcaacataggggtttcagagccaaccgccagtctgatattccccgagattttaaaggatttcttaaaggattacccaaagataacggttaatatcaaggttgatgacgccaatacctgcagtcaaaagcttttagacgggacgattgattttgcagtctgcggcgagccggagctgattcttgaaaattactaccatccatttttttatgacacattaaatgtgattatatctgatcaacatccgctcgctgagaagaaggctgtccatttgtctgatttagcagaagagcgcttcatatttacgcccgccaattgccccattcgcttacaaattgaacagcatttacatagagaactcgggaatcgctacaaaaaaatggagctcacaagcagcatgtcacatgaatattacgtacgtgaaaacatcggaatttcaatctttaccagcaccgcacattctaaaccgttcaacggcactaaagttattccaattctgaacctggatatcaccccgcccatagggctgttgacaaatcaaaaagaagttcattttgaccgcgccacgaaggacttgatcgcccggataaccaaacgttttcagcagcgcagcaaagaattggaaggaacctctgataagaccattacaggataactgaaaaaataaaaaccacctcctgattcatcaggagatggtttcacggtttaaagctcgatcgtctcaccgaccgacatgactttgccgactccgcccggcaggctgtcagcgaatgcttctgggtcttgttcgatgaccgggaatgtattgtaatgcaccggcacgacctgttttgcgcgcagccattcagcggcaagcttggcgtcttcaggccccatcgtaaagttatcgccaatcggcaggaaagcaaggtcgatatgattcaattcgccaatgagtttcatatcagagaaaagagccgtatcgcccgcgtggaaaatcgttttatcctctacagtcagcaaaataccggcaggcatgcctgtgtaagtgatcgttttgttttcttcatctgtgatggctgatccatgaaaggcctgtgtgagcttcacttttccaaaatcgaactggcgggagccgccgatgtgcattggatgaacattcaagcctttccagcctaagtacacagcgagctcgttcggtgctataaccagcgcgttattttgcttggcgatttgttcagtatcaccgacatggtcattgtggccgtgcgttagtaagatgacatccgcttttacatcctccggctttatatccgttaatgaattccctgttaaaaacggatcaaaaataatatgatggtccttcgtttccactgtgattacagaatgtccgtgatatgtcactttcatttctttcacctcgtcacatgattttgatttttttattttccctttttaaaaagctgaaaaacttatgttgtttgattcttgttaatgacattgaggcctccggtggcttcaatgacagtccctgtcacaaggtctgagttctcctcacacaagaaagcgataatccgggcgatatcctcgcctgtaccggatcttcctatcggcgttttttctttgccaattcgcattctggcttcctctatcgatgcttctttcatgtcgccgacaatgtctcccgggcaaaccatgttggcggttatgccgaattcggcttcttcaatggcaattgtcttcgtcaaagaagccaagcccactttcgcagcgccaaatgccgatcggtgaagccagccgggcgcgtgagccgcaccttggaatccgtacgtaatgatgcgtccaaattgctgttttctcataataggaataaccgctttgaataaatgaaagacggcgcttaaatttccttccagcatgccataccattcatcatcagtataatcggctaactttttacgttcaaatatgtatggtccagcgttgttaatcaaaaagtcgatccttccgaagcggtttaaggcagcctctgcaatacgcagcagatcttcttttttggtgacatcaccttttacaaattgcagccggtcaagacaatcgggacaggcttccttcaggcggctgactgcctcctcatcctgtctgtaattgactgttactgaatacccctttgcaagcaacgtttcagtcactttgcggcctaaacccttcgaaccggcagtaattaaagcatgtcgcacatgaatacctcccaaagcaacgtcgccgctttcaataaagtgtttcttcttctactttactataaaaggcttgcaatatcactttttacactttggcatacaaaaaaagctgtctgtacagacagcttattctgcaggagatgaagactcctgatcaggcatatcgacataaccgctttgatatgcttctgaaatgagccttgttgtctcctggctttcttgttcatcataaatatagcgttccggttcttttttcatcattctgcctcccatcattatagaggtaggttggctataatgacgggattttatgaaggaaattttaacaaactcctgctgccacgcaagctttcgctttttcaagcgcctgttccacctgtttgaatccggtgcccccggcgctcattcttttttcaactgcgtagtaagggtctaacacagtgtaaatatcttcttcgaatagtgtgctcgcctgctgaaactcgccaaacggcatatcgcttaaatagatccctctttcgatgcatgtgtacacaagtttcccgaccacttcatgcgcttctctgaacggcattccttttttagctaaataatcggccagttccgtcgcgtttgaaaagtcttgttttgttgcttgcttcatgacgtctttgtttacagtcattgtttggatcatgcctgtgaagatttgcaggctgccctccaccgttttcaccgtgtcaaacatgccctctttgtcttcctgcagatctttgttgtaagcgagcggaagtcctttcatgatcgtaaacagacccatcatatcgccgtatacgcgccctgttttgccgcggatcagctccgccatatcaggatttttcttttgcggcatcatgctgcttcctgttgcgtacgtatcgtcaagctcgatgaatttaaactcctgcgagcaccataaaatgatttcttcagagaaccgggataggtgcatcatcagcatactgctgttgcttaaaaactccaaaatgaagtctctgtcgctgacgccgtccaagctgttttcataaatggaatcaaagccgagcagttccgctgaataatcacggtcgattgggaaggttgttcccgcgagcgccccgcagccgagcggagatttgttaatccgcttcatcgaatcctgaaaacgctccttgtcgcgctcaagcatccagaaatacgcaagcagatggtgagcgaatgaaatcggctgggcacgctgcaaatgtgtgtagcccggcagaatcgtttcaacgttcgcttccgccttttcgatcagcgcactttggaatgcctcaatcagctcgatgatgtggccgacatgattcttcaagtataaatgcatgtcagtcgccacctggtcattccggcttctgccggtatgcagcttgccgccaagaggaccgatttcgtcaatgagcattttctcaatattcaaatgaatatcctcataatcgactgagaattccaatgctccctcgtctgctttttgcaaaagggtattcaggccctctcggattttcagctcttcttctgctgtcagaataccgcattttttcagcatggcagcatgtgcgagagaccctgtaatgtcttcagcaactaaattttggtcaaatgatatggacgcgccgaactcgtcgacccatttttccggtgttttttgaaatcggcctccccaaagcttcttcatgctttaatctgctccttctttttcacgatgctgttcacttttgtcggaagtccccaaagctcgataaatccgattgctgcatggtgatcaaatgcatcgtcttttgtatatgttgcaagtttttcatcatatagagagtattccgatttacgtccttctacaattgcatggcctttaaacagcttcacgcggacaatgcctgtgacatgcttttgcgtttcttttaagaaagcgtgcagcgcgtcttttaacggtgagaaccataagccgttgtaaatgatttctgacattttttgctcgatgatcggtttaaagtgggctacctctttcaccagtgtcaaatcttctaattctttatgcgctttgatcagtgtcatcgcaccagggcattcgtatacttcccgggatttaatgccaacgaggcggttttccacgtggtcgatacgtccgacaccgtgcgcgcccgccatttcattcagcttcaagatcagctcagaaagcgagtaggaaacaccgtcaatggagacaggcacgccttgttcaaatgcaatttcaatcacttccggcgtgtccggcgttttttccagcggagctgttaaatcgtatgcaccttctggcggcgccgcccatggatcttctaaaataccgcactcattggcgcgtccccagaggttttggtcgatagaatacgggctgtcaagattgatcggaatcggaatgccgcggctagccgcatattcaatttcttcttcacgtgaccactgccattcgcgaaccggcgcgatgacttctaggtcagggtttaatgatttaatggagacttcgaaacgaacctggtcatttcctttccctgtgcatccgtgggcaatcgcctgtgcatcttctttttccgcaatttcaaccagttttttcgcgatcagcggtcgagataatgccgaaacaagcgggtattttccttcatacattgtgtgggcctgcaaagagataagcgcgtaatcctgtgcaaattcttcttttgcatcgatcacgtaggagtttgtcgcgccgacttcaagcgctttctgctgaacaaatgccaaatctttgccctcaccgacatccaggcagcaggcgattacattatatccttgctcctgaagccattttattgcgacggaagtatcaagacctcctgagtatgctaatacgacttttttctgttctgacatgataaaaatcccctctcaaccgtgtttctattttgtataaaaataaattatatttaataaaaatacattttgtatgtatacactttaacaagtacgtttcgttttttcaagccttttataaaaaaaacttcacctgaatttcaggtgaagtttcatagtatttattcatttacttgtcttttctgatttctctgaccacatgcgcaagttcgggaataatcagcttattcattgccagctttactgcgccgcttgagcctggcgttgagaaaacagcggtatgctgaatgacgccggcagttgctctcgacatgattgcggcagagccgatatcctctgtataactcagcatcctgaatatttctccaaagccgggcagttctttcgaaaacagcggcgttatggcttcaattgtgacatcacgatctgctatgcctgtccctccgtttaagagtaccgcgtctgtctgttcatccatgcagcccgcaagcactgaccgctgcaaagcatccttttcgtcttttacaatttcatatgcagcaatatgatgaccggcttcttctaaaaatgagatcatcagcttgccgcttttatcggtttcctctgtcctcgtgtcactgacagtaatcactttgcaccgaacgatatcgggagcttcttgtttatgctcttgaacgctcataggcccacctcttttatgttttctgtctgtcactatcatgcatcaacaaaaaagcacattcaagagaatgtgctttcatgcgatttattttgctaaacgaacaacgtcgcgcgcaatcatgacttcttcatcagtcggaatgatcatgacttttactggagaatgcggatagctgatgaaagcttcctcgccgcgcacgttattaagcgcaggatcccagtatacgcccatgaattctaaaccgcgaagaacgcgttctctgacttccacactgttttcaccgataccggcagtaaagatgatcgcatctacaccgctcattcttgcagcgtaagaaccgatgtatttgtggattctgcttgcgaatacttcaagagccgtttccgcgcgctcatttccttctttcgttgcttcgacgatgtcacgaagatcgcttgagaaaccggaaatgccgagcagtccgctttttttgtttaatgtattcaatacttcgtcagccgtttggcctgttttctccatgatgtatggaatcagggcagggtcgatgtttccagaacgtgtacccattgctacaccggcaagcggcgtaaagcccatggatgtgtcaattgattttccgccttcaacagccgcaatacttgctccgtttccaaggtggcaggaaatcaggcgcaagtcttttaacggacggccgagaagctctgccgcacgctcagttacatatttatgtgaagtgccgtggaagccgtatttacggatgccgaatttttcatagtattcatacggcaagctgtacaggtaagactgctcaggcattgtttggtggaatgccgtatcaaatacagctaccgcaggaacatttggaagcacttctttgaacgctttaattccaacgatatttgccggattgtgaagcggtgccaattcagaaatatcttcgatttccttaatggtttcatccgttaataaaacagaatcgctgaatttttctccgccgtgaacgacacgatggccaattccgtcaatttcattcaagtctttaataatgccgaattccgttaacttattcagcagcattttaacagctaccgcatgatccggaatatcagttacttctgtatttttttcgccgttcacagaaattgtgaatacactgtcggcgataccgattcgttcaactaaacccttcgttaaaacggtttctgaaggcatttcgaaaagctgaaatttcaaagacgagcttcctgcgttaattgcaataattttggacatgattgacgctcctttatactctgtatcaacaacttcgtttttcgtacttttttcccggtgaatatcaacatcttctccgaaaaatatctgacttttccatttaaacattgtcatgtcggcttttcaagtcaacttgcgtattgataacgcttacaataagaagtcgttattttcagacacattccctatagattttgtattgatgaacgcttacaatttgcggtttttccctctgtattttgtgtttcaaagctggattcaattcgtcaagtccggtcttcaaaagcataaataaaagcagcttaggcatcgacctcatacggctgcctaagctgcttttaaaacacttacttttcttttttaaaccattcatcaaattgagccatcatatcaagcatcgccttttgattggagaaagacggaagattcgcaagcagaatttgccccggcgctttcgtattctctccttgtttctgaagcacaaggatgcttttggcatgagcttcgtctttaaaaatagattttggcagctgcaacagtgcgttgatatgaaccttatctttgaaaaactgtttcagcttgccgctttgggagctctcaaacaaatgattcggaatcataaaaaataagtagccgcccggtttggtatgcttgacgctctgttcaataaacagatgatgagcgaaggaatggccttcgtcagctttaagctcaaacgcttctgctccttcgtcattcggataatagccgactggcagatcacaaatgaccgtgtcaactggatcgataaacaacggctcaaggctgtcctggtggaaaagctcaagctcttttttcagaaggttcgcttgggcataggcgatcttcaagagcacatcatcaatttcaatgccaaagctgtttgccgttttttcagacagctggttcagcacggtaaacagaaggttcccagttcccaaggctggatcaagaatggtcagttcctttttgtccgccataaacttattcaccaaatagctgatgaaaagcccgatcgtatccggcgtcatttgtctgtttggatgggagatatctttcattcctttaaggacggcaagctgaaaagccttgcgtacccactcatgctcatacgtgccgaattccgctttttcaagcagagcctgaagttgtttggttttctgatcagcaggcagtttcagctgatccgttttttcaagaaaatacatttctcctgcttcggccagcgcctctatatatgaaatctgcaattcattctttatcataatcgctgcttcgtttaacagctcatacaccgcacctacatggtcgttttgcatattgtgttcctccttgccatgaaaaaagctccggcggcagcctggagcttttttccctgcttacttcactaatgccttagcagcctcaattggcttttcatagttcgggtggtttgttgcttcgcttacatattcagcgtaaacgacttttccattctcatcaaggacaaatacggaacgcgcaagcagacgaagttctttaatatacacaccgaacgcttcgccaaatgacatatctctgtggtcagacagtgtttccactttgtcaattccgttagcgccgcaccagcgcgcttgcgcgaatggaaggtctgcactgattgtgtagacgttgacatctccaagctttgcagcttcttcgttaaaacggcgtgtttgtgcatcacaaacacctgtatcaattgaagggataacagaaataatcgttacctttcctttcatgtcagctaacgatttttcttcaaggctgttagtcagcactgtgaaatcaggagcttgatctcctaccttcacttcttgtccgacaagtgtaaccggaccgcctttgaatgtaatttcagccattataattcctcccttttgtatgtatgtctctatcatagtaaagtttcctgcaaactgcaaagtttatgccaaaaaaaagttaactgcggccagcgcagttaacctttttttaataattcatattgttcatttggttttgattttggccctggccttggttcttgttatttttcttgaacatttgctggatgcgttcgagtgtttgaggggctgcgtctaaaattttctctattaaatgggtattttcatctaaatgaagcattctgatgcctgtcgatccgacaattaaaaacgcgatcggcgtaatggacacaccgcccccgcttccgcctccgaaaggaagtttctgttctcttgtctcatcgtcttccgatttcttttcggccggctttccgccaaactcgcttccgcctgcggcgaatccgaatccaactttagaaacagttaaaatcacacttccatcaggcgtttctactggatctccgatgatggtgttaacatcaatcatttccttcaagttttccattgcggttttcattaaaccttggatgggatggtctgccatatacgcttcctccttaaactgatgaatcattctttgaagtcattctagccgacggattcttctttaatacggatagctcccgtccgtatttgacgaatttgaaagctgcaagcatagcatgtccaaagcgaaaaaagaatatacactgaaaatgggtcttggaaacagggacttgaaacgacgggatcacctcatagacaggtttattcacaaagtccaggtggtcgtagagcattgctgcgataccgcctttcacaccccatacagcacctgttaacacacctgtcactgccgcgtcctgaattccgattactgtaacccattctagttttgtgatatgtaaatgcgcgagaaaagacgcgctgattttccgtagtctggtgacctgatgcaaaagcatttcgattttattaatgctttgctgcacatcgttttgtgtaatttttttctttccgctgctttttttcattttggattcagttttttgtttgatatccactgttccgtcttctttgttcaccttaatcgccgggattgtttttttgatccttataaggccaaacagcgccgtaatcttcaaagtcaatttgtcattatcatcggcatgaagatactccagcgcgacatggattttcattctgagaagcagtacgatccctatgagaataagaatggctgtcagtacatacaccatattcttcacttcctctaggagcattatcgccaattcctaaaaaaataaacccggacggaggtccgggttttcggttatttgcggtataatttttcatgcaccacggtggtatccgcgatgtaatcatgaatcccttgttttgtaggtgaaaaagcaacaacgatatataaaatccaaatcttatcaatataccgtccaaccacttcacgaaaaatcactgtactccatgtcagcttgctatcttgcttcacagaaaccactttgaggccgaacaccattttaccaagcgtctgcctgaagtattttgtcattagtgcgaaataggcaagatacacaataagcgttgtcacactgtaggccgagaaggtaaacatgccggatgttttcggcagatccaatacggtaaagaggggagaaacgagcaaatggtttaatccccatatcacgagccaatcaagcaggaaagcccagaaacgaacccaaaagccagcataggcatgtgtcagctgctccgcttcttgcgggcctttgatgtcattgcgctctaactcttcatatgtcgcgtccattattgttccctcctacttcgcatagagatacatcattctcggcgaaccggattgcgatagaatttctctcatattcaaaaaatcaatttcacttttaaacattttgttcgcacccatggaaaacagtgagcctaatccgaagctttcctcataagaaatgacagaggcgtttttcaaatccttgtgatcctttttcatggccgtaatggtatcgtcataaaaaccaagctcatcaacgaggttcagttttttcgcctgccgtccgtcatacacgcggccgtccgcaattttctttacctctgctttcggcatgccgcgcccttttgaaatgacatcaacaaagccttcatacgaattatcaaccatcgattgcatgatgtttttttcttctttcgtcatctcacgggaaggagacataatgtccttatgggccccgctcttaatcgtttcaaaagaaatgccaagcttatcggcaagctttgaataattgacgctttccataatgacgccgagtgacccggtcagggtttccggtgtcgcaaaaatcttatcagccgctgttgagatgtaatagcctcctgatgctgccatcgaacccattgacacgtaaatcggttttttagtttctttcttgatttcttccagtttcttatgtatttcagcactttcatacactccgccacccggagaattcaccttcagaacgatacctttgaccgccttgtcatcttttgcgcgctcaaggttttttaagaacgttctgtggttatatccgtctgcaccaagcagactgcttgagtccccattatcctgaatggtgccgctgacctctaatacggcaattttacttgagagactgccgttttccagcgtcttttcctgcgattcatccgtcagtgatgtgagatccgtttgagcgcctttgacgctttcaaagaaactcatagagatgctgacgataatagacacgccgaaaatccccagagcaatcactaatgcaatccatctttttgcattcattttttctcctcctttttcccaaactctctcattatacgattcaatatgaaaaatgtttcaattaatgagaaagctccggcttaacgggctgccggcaaacgtggtacacttatggccaaaggtattttatcacaaatactggatggcagaaaaacttaaatatgacagcaaaggggaaatgggatatgaccgatcaacgccgtaatgtttatttttttcacaaacaggatcaggaaacaaacgaacaagcccgctcgttaacacaattggctaaagagcatggatttaccgttgtgaaccagcactcagacgccaatattatcgctagcattggcggggacggcacatttttgcaggcagtccgaaagacaaattttcgtgacgactgcttgtacgtcggcattaccaaaaaggggaaagctcatttatattgcgactttcatagtgatgagcgagaaaaaatggtcgatgcaatgacgtttgaacaaattgaagtcagaaaatatccgctgattgaagtgacagtggataacgctagtccttttcattgcctaaacgaggtttccatccgttcaagcatcattaaaacctttgtgatggacgtgctgattgacgatctgcactttgaaacgtttagaggtgacggaatgatcatctcaacgcctacaggcagcaccgcctataacaagtctgttgcaggagcggttgttgatccgctgctcccatgcatgcaggtatctgagcttgcttctcttaacaataacacctaccggacactcggctcgccatttgtcctcagctctgaccgaaagctgacccttcgtgtggtgcaggacggcaacgaacacccaatcatcggcttggacaatgaagcactcagcacgagaaatgtgaaaacgatcgaaatcaaactgtctaataagaaaatcaaaacagtcaaactaaaggacaattcattttgggaaaaagtgaagcgtacttttttatagaaaataaaaggacaggctgctgcctgtccttttatgatttctcatatacaatctggccgttaatcacggtttttttaatctctaaaagatgaagctgtgcggggtcaatggcaaacggatcaccactgagaactgtaaaatccgcgtcatagccttccgcaatttttccgcgtgacttctctttataaatgataccggcgctaccttctgtataaagctttatcgcttcatatacaggtaaacattcactttcattatagcttggcccgttttgctcatgactgcttttccggaggaccgcggactggatccctagaagcggatcaacaggctcaatcggggcgtctgaaccgcccgcgcataaaatgcctttagatatgagggttttccaggcaaatgcagtcttcatccggtcttttccgagacggtcaatgacccacggaaagtcgcttgcaacgaagtgcggctgaaggtcaagtgcgatcggcatgcgtgctgctctctcgattaattcgttatcaagcacttgagcatgaataagccgatcatgccggccgtttttgggcggatgcttttctattgcgttcagcactttttcaaaagcaagatcgccgattgcatgaacagcaacctccatccctttttctctcgctttgcgaatgagccggccaagggtttcgtcatcgtgaacctgaacaccatttgttgatggatcatcctgatatggttctttcaataaagccgttctcccgccaagcgccccgtccgtaaagattttcatagcaccgaactccacatacgggccggacagcttctccagctgctcccatcgatcgacagcttcatgatgaacgagcaaatggcagcgaaacggatactttccgccagcggcagctttctcataagctttcatcggcaccgaaacatcaccataataggacaagtcttccgaatgaccgcccgtcaggccttttgtccagcaatcctttattgcagccgttaatgcctcatcaacatagtgttgagagactggcgggacagccttcagaatcaaatcctgcgccttatcaaacaggagtccggacggctctccatttgcatcttttacgatgactccgccgtcagggtcaggagtatttcttgaaattcccgctgcttgaagagccgcagaattgacagctattgcatgccggcatatacgcttgagcaagacgggtctgtctggaaacaggcgatcaagatcatgcttagtcaagtagtcaggtgtctcaaactgattttcattccagccctctccaatgagccaatcgtttttaggaagctgccgctctctttccttcgcagcctgtaaaattgcatctttcgacgtcagtgcggacagatcgagctgaagctgtttctcaccgtggccgatcaaatgtaggtggctgtcaacaaaaccggggaacatcactgcaccgttcaggctgatttcttctgtttccggtgacccgtacttttccttcaaaagttcatagctgccggtgccttttataacaccatcctcaacataaactgcctcagtccgatcgccttcttcgagcatcgtataaatgaaaccgccgtgccatatcgccttcattcacgttcactctctttctttacgcctttttattggctttgagctgttcttcacgttttcttaattccactcgtctgatttttgcagaagccgttttcggcaggctttccacaaattcaatttctctaggatatttgtatggagcggtaatcgtcttcacatggttttgcagcattttgacaagctcatcactgcgtttttcatgattttgcaggacaacatatgcctttacgatggagcctctgatttcatcagggcttgcgacaacagcacattcttttacttctgggtgcttaacaagcgcgtcttccacctcgaaaggcccgatcgtatagccggagctgataataatatcgtcatttcggctttcaaaccagaagtaaccttcctcatcttttcttgctctgtctcccgttaggaaataatcgccgcgaatttgtgttttcattctttccggatctttaaaatactctttaaagagcgcaggcgtactgaggtgaacagcgatatcgccaacctcaccaggtttgcagatttcaccgtcttcatttatgatctccacctgatttcccggtgtcggttttcccatgcttcccggtttaataggcgtatctttcaaaacaccaaccaaaagcgtgctttctgtttggccatatccgtcccgtaccttaatgccaaagtgcttttggaaaacatcaatgacttcacggttgagcggctcgcctgcggaaacagcgctgtgcagggcagaaagatcaaagcggtccaagccctcgaccttcgccattaagcggtattctgtcggcgtacagcagaaaacattgattttgtagcgatttaaaagctctagatatttttctgctttgaatctgccgtggtacacaaaaccggttgctccgctgccaagcaccgctaaaaacggactccatacccacttttgccagccaggggcagcagttgcccagacgatatccttttcagaaatgtcaagccaagcgccggcagaagtttttaaatgagcaaatgcccatccatgtgtatgtacaacacctttcggctgacctgttgtcccggatgtataagataagaaagccatatcatctcttgttgtgtcagctgttttaaattggcttccgtccgcttcaattgataagaggtttttccagccggcatcattttcaccaatagacagtgtaatcagtttgtcagccgtactgacatcccggaaagcgccaataaattcggagtagacgatagcgccttttacctctgcatgttcaatccggtattcaagatctttcgcgcgaagcatttcggagcacggaatgacaaccattcctgatttcaggatagccaaataaacagcataggcttcaagcacccgcggaaccattacaatcagcttgtctccctttttaaatccaagatcagctaaggccgctccgattttatttgtttcttccatcagcttttcatacgaccaagattcttgcttacccgactcgtcctcccacagaagagcggttttttgtccagcggcactgaacttttccatttcattcactaaattatattgcataggggcaattaaatcttcacgttttaacacgaacaactcctcactttctccacccattatacataaatacaggctctttccgtaaggatatgcctaaaagcaacctctgtaaacatagattttataggccgctggtccttttttatatataaaaaatgaaaaggagtggggatacccccactcctaagccattatgtgaaattgtaaattagaattgtcctccgcccatgttttgttgagcaaaagatacaagacgttttgtgatctctcctccaacagaaccgttagcgcgagaagttgtgtctgctccaaggtttacaccgaattcagaagcgatttctaatttcatttggtcgatcgcttgagcagctcctggtactaaaaggttgttgctgttacctgagttattgttagccatgtgtctcacctccttgtgagtatagaatgtgtcaaaacacatggcttcattcagaaaaactttggtaattgtatacaggagctgaaaattaatttaaaagagttcagcgaatttatcgttagcttcttgttcgctatacagggtcattgtctcaatgttatctaccgcttcttgaatatacggctcgaaatcaacaaagctttcaaagtgttcaattttctcttttttagggcgtgttttcgggcttggcggtgtaaagatcgtgcagcagtcttcaaacggctgaatgcttgtctcatatgtgccaatttcccgtgatttttcgatgatttctgttttgtccatggcgattaatggacgcaaaatcggtgttgacgtcaccgcattaattgcatacatgctttcaagcgtttggctcgctacctgaccgaggctttctcccgtaataatggcaagcccgtttctcttttctctgattctgtcggcgatctgaagcatgaggcggcgggttgccgtcattgtgtaattttcaggaatttgtttttggatgagctcttgcgtttttgtaaatggaacaatatgaagtgtcatgcttccccaaaacgggacagacatttcgccagatccattaccttttgctttgcgcgctcactcgtgtatggcgggctgaagaaatgaacagcttctaccgacagtccccgtttcatcgcataaaaaccggccacagggctgtcaaaaccgccagaaagcatcagcatcgcttttcctgctgaaccaactggcagcccgcctgcacctttttcatcacgaattgtcaaaaatgttgcttcttccctgatttcgattctgagcgggatgtctgggttgcgaacatcgaccgtcaatccttctgtatttcgcaaaatatggccgccgatttcagcgttcatctggtttgtatctaattcaaattgcttatacgctctctttgtcgcgactttaaacgtatcacctggtttatattgatctttgatagcctttagtgcggttgccctaatatcatcaaggcggctgtcacacttaattgccaggctgaagctttgaatcccaaacacttgctttaaatgaggaaaaagagcctcaggatcctctccatttaatgtaatcgtcatacgatccctgttggaaaagtattttaaattcggatagtctttcaaaacgagtctgatgttttgttttaagcgctcaataaagctttttctgtttttgcctttggtggaaatttccccaaaacgaattaatatatgatcgtaattcatgttctacctcatcatttcccttaattttttgataccaggacgaagcgcgttcataaacggttctgccacatcgcttgtctggctgtaatttaaactgattctgatgctgcttccggcaatctgctctcctttgcccatctctaagagaactttactgggcttatgttcttttgccgagcaagccgatgttgtggagacgaaaatatcctgttcctcaagcatgtgtaaaagcacttccgctttaatccccggtacagagaaattaataatgtgcggcgcgctattcatttgaggcgtgttgataacgacgccctcaatttcactcagccttttcataaacaattcctttgcggcagtcatcgtgtcaagccgtgtgtcaaaatcagcagaggccagattaatggccttggcaagcgaaaccgcaccagcagtatgttctgttccggcccgtatgcctttttgctgagagcctcccgttatgagcggaataaggcgtgttccttcttttacaataagtgcgcctgtcccctttaggccgtgaaatttatgccccgaaattgaacatagatcaatgccggccttttcaattgccaagggcactttatagatgccctgcacataatcgacgtgaaacaaaatgttcgaatgctctttcagcacttctcctgcctcttcaatcggctgcacggaaccgacttcattgttcacatgcatcatgctgacaagcacagtatcgggacggatggctgcttttagttcttcaatagaaacaaatccgtcttcattcacagaaagataagtgatatcaaacccgaacaactctttcagctgttctaacgattccgtaacagatggatgttcaatagaagtggcaatgatatgtttgcctgtttttatctttgacaaagccgctccttttaaagccgcattattggcttctgtggcgcctgacgtaaatacaatatcatatttttttaggcctaaggaccttttgatttgatttttggctgcttgaagcagctgttccgtttcggctccatatcggtgcaaagatgaaggattgccaaagtatcggctgcttgtctgttcatacacgttcaagacttcatcgtaaggcttcgtcgttgaactattatctaaatatatcatcttttttactcctttatgaaagcggtacaaggtatgatatttatgttaccataacaaaatttaatagaaaattacgaaaaactagtattgacttctaatttttttaccatataataagatttgttcgtttcgtcatattatctgacaattaattgacagaatattttaacataattattaggaggatttttttcatgaaacactcactgcctgtcaaagataccattattattggtttcatgctatttgcgttattctttggagcaggaaatatgatctatccgccggaacttggacaagcagccggacacaacgtctggaaggccatcggcggatttttactgacaggggtaggcctgccgcttctcggcattatcgccatcgcattaaccggtaaggacgctaaaggccttgctgacaaagcgcaccctgttttcggcacaatctttactgtcgtgctttatttatcaatcggaccattattcgccatcccgagaacaggaactgtttcatatgaaattggcgctgttccgtttttgactggcgtaccagaaagactttctttattaatatttacacttatctttttcggcgttacgtactatttagcgttaaacccatccaaggttgtcgatcgagtcggaaaaattctgactcccatcaaattcacaattattttaatcattgttctcaaagccatcttcacaccgatgggcggattgggcgccgtgacagaagcatataaaggaacaccggtttttaaaggatttttagaaggctataaaacaatggacgcacttgcttcaattgtatttggcgttgtcgttgtaaatgctgtaaaaagcaaaggcgttacacagtctaaagctcttgctgcagcctgcattaaagcaggtgtgattgccgctttagggctgactttcatttatgtatcccttgcttatttaggtgcaacaagcacaaatgccatcggtcctgttggtgaaggagctaaaattttatctgcgtcttcccattatttatttggttcattgggcaacatcgtactcggagcagcgattacagtcgcatgtttaacaacaagcatcggccttgtcacatcttgcggccaatatttttcaaaacttattccggcattatcatataaaattgtcgttacgattgtcacgttattcagcttgatcattgcgaatttcggactcgcgcaaattatcgcgttttctgttcctattttatcagctatctatccacttgccattgtcattatcgttctttccttcatcgataagatctttaaagaaagacgcgaagtgtacatcgcttgcttgatcggtacaggacttttcagtattttagacggtatcaaagcagccggtttttcacttggatctttagatgtgtttctaaatgcgaatcttcctctttacagcctcggcatcggctgggtgcttccaggaatcgtcggagcggttatcggctatgtgcttaccttattcatcggaccatccaaacagcttaatgaaataagttaatgtcacagaacgcctgcgttattgcgcaggcgttttgtaatgaaaaaaagagcctgctcattacactgcgggctctttttcatagtcgtgattatctaagcggatatgtctgctttgattttttcaactgcacctggcgcagccttttctacagcggcagctgcaatttcataagagtcgtcataatcaaaagcataaaaacgtctttccgcttctttcagctgttcagataaaatatgattctggcttctgaaccggtttccgaactgaatgattttttcaatgaggatgacctgctcgacaagttcctctgattcccggcttgccctgttgacgatttcttctgcttgtttcaaatgggctccggcttcttccatatttaatggaagttcgtttagttgattgactgtttcttgaatatgatgatgcgcgttctccagcatctcttgaatatggctcggaatgcctggaatgttgctagtcttcagcagtctagctgtctcagaaattgtttttttcaaattgctgagcgtctccctcgcctgaagctcttcttttctcagcgcttgcagattttcacgatactcggcatgctcttttttcacttcttcaatttgcttctctattgaagcaacttcttctactaaaagtgagtaagcgacatgctctgcatcaagcttatctttaacggatgatagcagctttccaatttcatcaaggcgcttttcaaaagcctgctgtttgccgagctcaccggctgtcagcctgtagctttccttcaccagctcagtttccgccttcgtatgctctttctcttctttaagcttgtcgtaagcaataatcaattcaggcattttgcttagtacggattgaccggcttcaacttcgccctccagctgctgataaacagattgaatattttcgtcaatgagctgcaggattgcggacgcttcatcaatatccagctcagtcatcaggacatgttccgctcgtttcagctggtttgacagattttctaattccttatcaagctggatatgctcaagcttgtaccctttttctttcatttcgccatagccatccttgagctttgcaatctgtccgggcaccgtctgtttacagtcagctaacagcttcggcacatcatctatgtatgactgaagccgttcaagattgcggtcctgctcaagcagtacttttcgtgcagtaatatagtttccgccttctgtttcttcttcaaattgtttgatgccgctccaaatttcgtccagatccttttcaaggctgtcataaagctccccgtaaaggtggctgtaagccagcaggttttttcgagatttcgaatagcgctccctcacctgttcaatctcttcacggctcttttcctcacttgtgacaagatcgctgatttcccgaagaatcttttcaatgcttgattcagccgctgtcagcaggtcgtcgatatgaacgagcacttgattggcctttttaaaccggtatttgtctgcattttcctcggcatcataaaggagctcttcaactttcggcatgtgggctgtgacaatctcatcccattcttcacgccacttctcaaagaactcttctgtctgacccgtcatttttaaatgttttattttagacatttcttccacgatcgaccgattcagaatttcaatcttccacgattccagccggtcgatttcggcgtagatttttttcctgaaaaagtagcctgccgcaaacagcgcaagcagtacaattaataatccaatgacaaactccataatgagcccccttgctgtttaccttaatctgtcagggtgttttatttattcagaaagatttcaggatatgtattgagaaaaactgtcgttttcattgttattatgataccatgtaacaaacattttttgaccagaaatcaaaaactttttgtgcaaaatcggcaggatttgactattttttcatggggtgacatcaatgcaaaagcgagacggacatattcacacaccattttgccctcacggctccaatgacacactcagacaatatgcagaagaagccttaaaaaaagggttcgaatcgattacttttaccgaacacgccccattgccgccctcttttaccgatcccacgccgctgaaagacagcgcgatggcgcaagcttctttggaacgctatattcatgaaatttccggattaaaaaaagaatatcgcggacagcttagcatacggacagggcttgaagtcgattatatcgctgaatttgaagacgaaattacattattcctagacacatacgggccatatttagatgacagcatcttatccgttcattttttgcgcacagactcttcctatctatgccttgattatgacgagcataccttcaaagagctgatttcagcctgcggaagcattgaagcggtatatgaacaatattaccggagtatctattcttccattgtagcatctctcggcgtttataagccaaaaagagtcggtcacatcacactcgtccaaaaattcatcaagctgtttccatacagcatgtcagaacatattcgcggcctcgtttccctgtgcctgaatgccattgaagaaaacggaatggagctcgacttcaatacttccggcttaagaaaaacttatgctggcggtatttatatcgaggattggatgctgaatgaagcgaagcaaaagaagatcccgcttgtgtttgggtcagatgcccatcaagcgggagatgtcggatatgcgtatgagacgtttttggaacggtgctagttggtgagcgccacgtctcctgtccggaagacgcttctgatccaaatcttgatttcttcaaaatacattttataaaaatacggctcgtgcggctgcatgtagagtacttctgaaatatattgaggctggagatagggcatcatcaagagagattttaattggagaataaaatgaggcagcggcagcgttaaatattcacgctgtttttctccttcctcaatgatcagctggaagatatacttttccttcattagatatgtcgacataatttccctgattaatgtggagtcaattgtgacttcccggtagacaaaacgagttaattgacgatgattatgctgataggataaaatatcgaaaaccaattgaagaagctgttcctgcgtgctttgagaagagatattgcttgccgctgtttcaagcgttttgctgtagccctcgtaaaactctgaaactaagtgttccatcaagcctcctttgcctttaaaatagtaggagatgtgcgcaacatttacatcagctgactttgcgatttcacggacagacgtgccagaaaatcctttttggttaaaaagcatgacagcagattcaataattttgtctttggtgcttactttcatacggctcactccttcctcttgatactattcaagcagaaagccgctgttcctgtaagaacttatcgacaaatgccggcagaaaagccggaactttgttttatattatagaaaaagtgagggttttccatgttccatgtcgaaaaacaatctggagataaagaaaaagactatcagcttctgctaaaacagctcgaagccatgaccgaagacgaaacagaccaaatagctaactatgcaaatgcctcagcactgctgtatcattcgctgcctgaagtcaactgggcgggtttctattttgccaaagaagaggatggacagcttgtgttaggtccgttccaaggcctcccggcatgtgttcggattcctttcggcagaggggtttgcggcacagcgtacgcaaacggaaaagtggaacgtgttgaggatgtaaacgcgtttcctggacatatcgcctgcgatgcagcgtcccaatcagaaattgtgcttccgattcgtgtagacggaaaaattgtcggcgtcttggacatcgacagcccagtgaaaaaccgtttcgacgaaattgatgaaaaatacttaactcaatttgccgaaacgctagaaaaagcgttagcgcagtaatataaaagcccaaaactgatatcgttttgggctttttttattttattgagtcatgaaccatcaagcggtttttcccgctccgtttcgcgctgtagagcgcttcgtctgcctcatgcacaagctctttcagcgacttttttgtttctgtcgtccagcaggagataccgcaggaaatggttacctcgggtttcgtattttttctgaccgcgtaaaccagccgctcggtaatccgtttccccactgcaaccggcacatttggcaaataaatcgccagctcctctcctccccagcgggcaccgacatcatgctttcggatgttgcttttaatcactgaagcgacttgaattaaaatctcgtctccagtctgatggccgtacgtatcatttacatttttaaaattatcaatatcaacaagaataaaaacacccttttggtggattttcatgctgtattgaattttttcatctaaatacgctcgtgaatacagttcagtcagctgatctgttttcacgagatgctcaaggcggtcgcgaagcattgaattggttacagccagtgtcgcgtgatgaatcagcgcctgaaacagcttgtacatttcaaatgtaaaagcgtacagctcctgtttcaataaaaccgcaaagcctaaaagccggtcgttttgaatcatcggagcagccatcagcgagccgtaccccgccttcccaaaaacagactggccattcccgatgaaaacccctttttcaccttcatacagcttttctttcagctcattataaaaatctgacggcttcgcttctttaaaaaatgctgtgctgcctggaagcaatgttaggttttcaaaatggtctatatgaaaaaatcccacttcttctgcctgaaacgattctgccattctcacagccagatcattcattgtatcagtcagtgtcagccgctgattcaggcggcgtgatgtttcattgatcaattccaaatttgcgatgcttgctttggattgttcgtagagctgggcattttcaaacgcttttcccgccgcgtttgctaacagcgacatttcatcaaggcaggcatcagcaagaaagctgtcacccattccctcagccttcaacaccccgtatgtgccctgctgtcctttgatcggaatataggcggcagattcatttttccgcaaaatgtctccggacaaatacactttgagcgcaaaggaatcggatttttccccttccatatacagctcttttgcaggtatccctaaacattggtcttgatcgtgcgatataaataaagaaaactcaaaaagagaaaatgtgctggtcaagctttctaaaagctgcttcagcacatctgtctgatcaagcagtgaatggaacagctctgtcattttgtatatctttttttggtagatcgttttgttatagagtctttcctgtttcatcgactggtttaaaaatgaagcaaccacgttcggaagcccttcaggaatctcttcatcctgcctgcatgcaagatggaaacgcctgccagagccgtcctcaatcagataacatgaagcgtttatttttgaagcggaaaaacgcgcttcaccatctgccagttttgtcacaaagtctgatggtgacggtgtaagcgaaacacaaagggttgaaaaataggtttgaatagccgaagtcagccatattaaagagtcggtgaatgtgactttttcagatttggttaataaaaaatcgagcatatgataatgaaaggcggataattgatctttagtttgttctaccatgtttttatcacctaaaagtttaccactaatttttgtttattatatcataaacggtgaagcaataatggaggaatggttgacttcaaaacaaataaattatataatgacctttgtgtgaaatattgcagcctttttgttcagcttctatgttttcattttgttccttatcaataaggtgtatcgtgtaactctctgctgctggagcgaggatacatgaaaacaaaatgtgcatggtcgaatagagcagacggtttttattttccacaaaaataaaaccaaaggaggagtcacattatggctcgctatacaggtccatcttggaaactgtcccgccgtctaggaatctctcttagcggtacaggaaaagaattagaaaaacgcccttacgctccaggtccacacggcccaggacaacgtaaaaaattatcagaatacggtttgcaattgcaagaaaagcaaaagcttcgtcacatgtacggtgtaaacgaacgtcaattccgcactttgtttgacaaagctggcaaactagctggtaaacacggtgaaaacttcatgattcttttagattctcgtcttgataacgttgtgtacaagctaggtttagcacgtactcgccgtcaagctcgccaattggttaaccacggtcacattcttgtagacggaagccgcgttgacatcccgtcttaccaagtaaaacctggtcaaacaatcggtgttcgtgaaaaatcaagaaacctttctatcatcaaagaatctgttgaagtaaacaacttcgttcctgaataccttactttcgacgctgaaaagcttgaaggtactttcactcgtcttcctgagcgttctgaacttgctccggaaattaacgaagcgcttatcgttgagttctactctcgttaatcgttttaaaaacccctgccgctatgcggtcggggtttttttatcgtctattttgtcttttgcctcttgctggccaacactatcctgcgcctgctgctcccagtaatcctgctgcagccgttcttttgcaatcgtacacatgagattcacgctttagcgctcctttcatttaaaaggtgttgattggtcgtgtttgccctatctaatatactcttttcctttcattcctatgcggtaaacaaaaagatcctttgccttcagtggcaaaggatctttttcttatttatacgtcacaaggaagtattttttcttcccgcggcgcagaacagtaaattggttttcgatacggtcttcacctgatagggtataatttatttccgtctgtcgttcaccgttaatgtaaacagctccgttttgaatgtcttcacgcgcttggcgtttagaaggagataatttagattgcaccaacacatctacaagtgaaagctcttgggtgctgtcaacttccatagaaggaacatctttaaagcctacttttacgtcttgagcggaaagctctttaatattgccgctgaacagcgcttgggagatgtttatggcttgctccagcgcctcgcgtccgtgaacaagtgatgtcacttcttctgccaggcgtttttgcgcttcacgtttttctggcgccgtttctgttttttcagcgtacgcttcaatttcctcttttgaaaggaacgtaaagtatttcaagtatttgacaacgtcacggtcgtctgtgttgatccagaattgatagaattcatatggcgatgttttttctttatcaagccagatcgcgccgccttccgtttttccgaacttcgtgccgtctgcttttgtgacaagcggaatcgttaggccgaacgcttttgctccttcttcttctgattttctgatcagttcaagacccgctgtgatgttgccccactgatcgcttccgccgatttgcagtttacagtttttgtctctgtaaagatttaagaaatcataagattgaagaatcatgtagctgaattccgtgtacgagatgccggattcaattcttgagctgaccgtatcttttgccagcatgtaattgatgccgaaatttttaccaacgtcacgaaggaaatcgatcacattcattttgccgatccagtcaaagttgttcgcgatgacagctgggttttctgctgcttcaaaatctagaaatctggacagctggtttttgattttttgggaccattcggatacgatgtcagcagtgtttaatgtacgctctgctttttttccgcttggatcaccgatgaggcccgtcgcgccgcccacaagcgcaatcggatgatgccctgcaagctgaaaacggcgaagtgttaaaataggcagcaggtgtccgatatgcaagctgtctgctgtcgggtcaaagcctgagtacaagcggattttttcttcattcagctgtttatttaatccttcttcatctgtcatttgctgaatcaatccgcggaaggataagtcttcaagtaagttagtcataagataaagctccttttttgattaaaataaaaaacgccccttcgtttacacgaagggacgattgattatcgcggtaccaccctactaataagagaatgcaaacattcgtcttatcactttgcctgataacggatcaggtccgttctttcactactgaaagcctggccggctttgtttgcaaaagcggttcatgagtgtattcgatatatccgtctgtgctgattttcaccggccatcagctctctggaacgtaaggatattctacttgtctcaatctttaccttttcatatgaagctatatcatttttaacataaataaaatcctgtgtcaacgccgccttttaatcctccattgttgacagatctccagccggcagattaagctcccatgccttcagcacgcgcctcatgatctttccgcttcgggttttcggaagcttatctttaaattcgatctcacgcggagccgcatgggctgcaagaccctgctttacaaataggcggatctcttctttcagtttatcagacggctcaaatccttccctgagtgcaataaaagctttaatgatttctccacgcaccgggtcaggctttccgattacgcctgcttctgcaatagccggatgttcgacaagcttgctttccacttcaaatgggccgacgcgctcaccggaggtcatgatgacgtcatcaactctgccttggaaccaaaagtatccctcttcatccatgtaagcagaatccccagacacataccagccgcccggcatgaaatacgattcatacttttcagggttattccaaatggtatgcatcatggaaggccagccctttttgatggcgagattgcccattcggtacggcggaagctcgttgccttgattgtcaacgatcgctgcctccactcctggaatcggcttacccattgaacccggtttaatatccatgcaaggatagttgcagataagctgactgcccgtttctgtcatccaccatgtatcatgaattcgtttgttaaaaactttatgtccccatctgatgacttccggatttagcggctcaccgacactgagcacatgccggagtgaagttagatcatatttcgcagccatttcatctcccgctcccatcagcatccgaaaagcggtcggcgcgctgtaccagacattgacgccaagctgttcaatcgtaccataccagctttccgggctgaaacgtccgccgacgatgacatttgtcgctccgttcagccacggtgcaaaaatgccgtataccgtacctgtcacccagcctggatcagccgtgcaccaataaatgtcttcttcctttaaatcaaggacccactttcctgtttgatattgctgaatcatcgcttcatggacatgcagcacgccctttggcgtaccagtggaacctgatgtatagtgaagcagaaagccgtcttttttatccatccattcgatatccagtcttgtgctttcctgtttcgctgcttcatcataattgatgatattcgtgccgctctcagcctctccccgactacgaagacatgctgcaagtgaggcagtttgtctaccggtattctctccagcagctcaggtgttgtgacaacaacctttgcctcactgttttcaagccgatctttcaccgctccctccataaatgcttcgaacagcggcccggcgatggcgccaattttgattgcgccaagcataataaaataaagctcgggtgatctcggcataaaaataaaaacgcggtcccctttttccacatttccataccgtctcagcacattcccggctctgtttgattcttccttcatttctttaaatgtgtatttttcatccctttttgcgtctttataataaagcgctactttgttttttcgaaacgattcggcatggcggtcaatcgcttcatacgccgcattcagtttccctgtctcatgccaagagaaatgtttctctgcctcggcccaatcaaaatgccggtacgtttcttcatagttttttaagttatgatccccctctattgctggtaacgctttcaaattcatgcccaaacatccccctttgctgaagttgtcacaattattatagtatatattcatattcttctcaatttttaaaatataaaccatgttgaaaacgctttataatttggtattcttaaagaaggcatgtatttttgataagaattgatgggacggtgaattagtggaacatcataaaacataccattcagcaaacatcaaaacagcaaccggctctttactgatagaagggcctgtctctccagaggatttggcaggttatgagtttcataaagatttaaccgcatttcgcccgcctcgcgagcagcatgaagcgctagtcgacattgcaggccttcccgaagggcgcattattattgccagagacggccgaaccattgtcggctatgtcacgtatttatatcctgacccgctcgaaagatggtctgaaggaaatatggaggatttgattgagctcggagccatcgaagtagcgccggactatcggggatgcgctgtcggaaagacgctcctgaccgtcagcatgatggatgaacaaatggaaaactacattgtgatgacgacagaatattactggcattgggatttaaaagggatgaaaaaagatgtgtgggaatacagaaagatcatggaaaagatgatgaatgcaggcggattggtctggtttgcaacggatgagccggagatcagctcccaccctgcaaactgtctgatggcccgcattggaaaaaacgtcagccaagaatcaattgagcaatttgacaggctccgtttttatcatcgttatatgtattaactgacactggcaaaggggaaaaaataatgattgttgagcaaatcatgaaaagagatgtcattacattaacgaagacggatacgcttgaacaagcaatatgcaaactgaaggaattccatatcaggcatctgcctgttgtagatgaagaacgacacgtgatcggcatgattacagacagagacatgaaacaggccagcccgagtatttttgaagaaaacaaacgaagcctatttctcacacgaagcgtagattcaattatgaaaaaggatgttgtctgcgcccatccgttagattttgtcgaagaaatatcagccgtgttctacgagcatggcatcggctgccttccagtggtacaccatcaaaaattaataggcattttaacaaaaaccgatttgctgcggacgtttgtcaaattgacaggcgctgaccagccgggatcgcaaattgagataaaagtaaacgacatcaccaaaagcctcgctgagatcagcagtctttgccaagaccttcaagtgaaaatattaagcgtgcttgtttatccgcatgacgatcccggtgtaaaagtgcttgtcttccgtgtaaaaacgatgaatccgctgccgtttttgcaggcattacaaagaaatggacaccacgtcgtatggccgtcagagcaaagggacctgctatgagagacagtgtatttatctattctccatcctaccaaacctatatgtttcatcaggagcatccctttaatcagcagcgggttctgttaacatatgatttgcttaagacgatcaatgcctttgatgatggagacattgtcacccccagactcgcttcagaagaggagctttcccttgtccacacggacgattacattcaggccgtaaagcttgcgggcgccggaaagcttcccgctgaagaaggagaaagctacgggctcggcactgaagacacacccgtctttgccggcatgcacgaagcggcatcactcttggtcggcggcactttaacggccgcagactgggtcatgtcaggacaagccctgcatgcggcaaaccttggcggagggcttcatcacggctttcgcgggagagcttcagggttttgcatatataatgacagcgctgtggcgattcaatatatccagaaaaaatacagatccagggtactttatattgataccgacgcccaccacggggacggtgtgcaatttaccttttacgataatcctgacgtatgcacgctgtccattcatgaaacaggaaggtatttattccctggaaccggtcagatccaagaaaaaggcagcggaaaaggatatggctattcctttaatatcccgcttgacgcttttacagaggatgattcttttcttgaggcttaccggacagcagcttcagaagtcgccgcttatttcaagcccgatgtcattatcagccaaaacggcgccgatgcccattactacgacccgctgacgcatttatcagcaacaatcaatatatacgaagaaatcccccgtcttgcacacactttggctcatcaatattgcggagggaaatggattgcagtcggaggcggcggatatgatatttggcgtgtcgtgccccgcgcctgggccagaatatggcttgaaatgaagggaattgacccgggacacgagatcccgccggaatggattgctaaatggcaaaaacaatgccccgtagcccttccgtcgagctggagcgatccggctgatttatatcctccgattccccgcaagcctgaaatcacagaaaaaaatgcccaaactgtcagcaaagcattatatgcgatacgttctgaacagcaaagaacaaagtaaaaaacgacctttacgaagaggtcgtttttgattttttgatcactatttccacacgccgattttccttcatgtgttcatttgtcttgttatccttcaccggctttgtatccgcataaccgacagcaataaagcgcttggagggaagcttctctttagacgtgaagtattgaatcactccacttgcccgtgctgctgatagctcccagttcgacgggtatcggtatgtcgaaatgtttcggctgtctgtatgcccctccacctgaatgtcatttggaattgtttgaagaagaacggcaatttggtgaagaagtgtttcggcatttttcagcacctttgcctcacctgtatcaaacagcacagcctcctgaagaacgagcacgacaccgcgttcatcccgtttggctgtcatttgggcctttaaatgattgtcttttatatatgtatttactttcttgagaagctgatcctgctgatcctcttgcttcttcgtatcagatggggatgtattctttttttctatggatgtttggtccggctgaagcccgttgccttccttctggatcgagtccactgccgctttaaatttttgcagatcgatttgggacatcgaaaagagtaaaataaagaacacaaggatcaaggtgatcaaatctgtaaaggttaccatccagctggatgaagattgactgttttttccgcttccattccttctttcaaaacgttctcttctaagcttcatgtacagatcccttttttgtttttacttgttttggctgcttctgccattcttcccgtgagctgaaaacgaccagctggctttcaaggttgcgcgggttttttccggattgaacaccgataatcccttccaccattacctgcttgataaaaatttcactttctgttttctcttcaagcttagccgcgatcgggttgaagaccatatttgccagtaatgaaccatataaagtcgtcagaagcgcaatggccatgtttggtccgagcatatgcgggtcatttaagtttttaagcatcagcacaagcccgacgagtgttccgatcattccccacgccggagcgaattctcccgctttttcaaaaactcgccgcccttttcggtgccgttcctccattgctgcgatttctgaatccatgacgagccgaatcgtttcttcatcccagccgtcaatcgctaaaagcagcccttttttcaagaatggatctttgatttcccgagcctgatcatccaatgataaaagcccgtgttttcgcgcgtgatcggaaagggaaacaaaggttttcacaagatctttcacattgttttcctggcggatgaatgcctgctttaacacagagggcgcttttttcagctctcttggcggaaaactgataaaaacagcggcgcaaagtccccctgttacgatgaagaaagaggtcagatcaagaaaagagcggaaaccgcttactccagatcccgaaataatcccgataacaataataatcgttcctaacacaaatccaacaggtgtaagataatcaaaacgtttcatcatttctccccatgaaaaaagcaagaattcaccataaaggtgaagcttgctctttgtttttcttatgacttggttgactttctaagctctatacggtgcggcagttcgacgatatgctcttcaaccggctctttattcatgagcttcgtcagcagtctcatcgcaacggcgccgatatcatatgtcggctgaacaactgttgaaagctgcggacgaaccatgaggcttaatcttgtattatcaaaaccgataatgtcgagatcctccggaatggataagccctgatcctgagcggcatggataatgccgagtgccatttcatcagttgcagaaagaatggctgtcggttttttatccaggctcatcagatgctgcagtgcttcgagtccggaatcatatgtgtaatccccttcagctacaaattgttcattaaacggaaggttcgcttcttcaagcgcacgtttgtagccttggagtttttttgaacggttgatcggttctgccattggtccggaaacgaatgcgatgtctgtatgtcctttatcaaccaaaagcttcacagcatcataaatcgcctgttcgtaatcgatagcgactgacggtgtttcctcctgctcttctacagaagcggcaagtacaatcggcactggggaacgcttaaattccgccacatgctcgtccgtaatgtttccgcccataaacacgatgccgtccacttgtttgccgagcattgtgtttaacaagtgcagctctttctccatgttttggtcagagttgctcaaaataatattgtatttatacattgtcgcgatatcttcaattccgcgtgcaagctctgaatagaaaatgcttgagatatcgggaatgatgacacctacagttgttgtttttttacttgccagccctcttgccaccgcgtttggacggtaaccgagacgttcaatggcttccaagacttttttcctcgttgtcggttttacattcgggttgccgttcacgacacgggaaacggttgccatgcttacattagcttctctcgctacatcgtagatcgtaatattgctcatcctaaaaccactccttttactggatacacttatccttatctatagcataaacactttatgtagagaaatgtcataatgtccgaatttatgtcgtttatgatttgtaagcgtaagtcagtagtgtacattatttttcattattcatcaaatttaattacttctcatgaaattatacacgtttttatagatgatgaaaacgtatacttggtttttataactaaataaacgagaaagcataaaaaaaggccgcaggcgcggccttttggattgttcaattaagcgttgactttcaccattggcttcagttcattcagccatttttcgaattcaggaatcgccatttgctgagcagagtcagaaagtgcgaccgacggatcagggtgaacctcagccattacgccatctgcaccgatcgctaaagcggctttagctgtcggaagcaagaggtcacggcggcctgttgaatgcgtaacatcaacaaagactggcaaatgcgtttcttgtttcaaaatcggcacagctgaaatatccagcgtgtttctcgttgctgtttcatatgttctgattccgcgctcacaaaggataatttggtcatttccttgtgacatgatgtattcagcagcattgatgaattcagagatcgttgcagcaagaccgcgcttcagaagcactggctttttcacggcgccggccgctttcagcaattcgaagttttgcatgttgcgcgctccgatttgaatgacatcaatgtagtccagcgcttcttcgatatgagccggagttacgatttcactgataaccgccagatcaaattcatccgctacacgttttaaaatttgaaggccttcaacaccaagcccttggaaatcgtatgggctcgtacgaggcttaaaggctccaccgcgcaaaattttaatcccttgttttttcgcagctgcagcgacttcagctacctgctcatagctctctaccgcacatgggcctacaatgaatctttgctggccgtctccgattttttcgcctttgatatcaacaattgtatcttcaggttttttcttgcgggagacaagcagcgctttgctgtgatcttcttcctgaagctctaaaccggctttgaatatctctttaaaaatgtgctggatggttgaattttcgaacggcccgtcattgttttcaatgatattgtttaacattgtgcgttctctgacagggtcaaatcggttgacaccctgtgcttccttcgctttaccgatctcttttacaacatttccgcgttcgttgattagttttaaaatttgtaggtttaattcgtctgctttctgccttaaaagctctaactctgtgttgctcatttttttcatcctttccctgcacattcattttttattttgtagttatcatgcatcttactataagtaattccaaatggaaatactgaaatacaaaaaattttataaaaactctactttattacccaaacgcttttaagtgataaagtaatctatgaagctatcctacatgatgtgagggcaatgttcaagggttttttacaaaaaaaagcgccagatgttatctggacgcttttttctatgacaaatgctgctcaatagcggcttctgtaatttgtgaatgtgaggtatgccatttcacttcaccgttctggatgatgaatacctgagggctttcatgcttgaccccatatgtttctgcaatgaaattggacagcggccgggcttcttgtacttgaagatagtaagccggcacatcctcatgctgatttgcaaaggcatcaaactcatgaaatgctgcctggctgatcgggcatgtggtgctgtgtttaaagaagacgaaagcgccttcctgttctgcaatccgtttaaattcttcctcagattgaataagctgtttagccatgactcaagctcttccttccctgctcagcgattcaactgctcagcctgtttttgtgcatctttcagttcgtcttttacatcttctttcgtctggaggacttgatcttttgtttcatcggctgcctgcatcgcttcttccctcatatcctgcattgcagtcgatgaatccgttttgtcagatttggaacggtctcttaaatcctttaccttgttcatgatctgcccagactgatccgctacaagctgtgtgatattggaagttttgtcttttgcgatgctgacatattgcgtgcctttttccttcgcatctgccgtcattttatcagttttgtcccgtaaagcaacagcctggctgccgagatcgtcgcgaagttctttgcctgatttaggcgctagaaaaagagctgtagtggcaccgatgattcccccgattaaagttccgattaaaaaatctttactattaattccatctttgctcatcattattcctcctcttagtatttttttctcttatagggctgattttttcttttgcttccatttctcccaaatttccattgctgcttgactccatgtgacaacttgattgatcttatcttgattttctctaactgatgccgatacagaccctgccgcttgtttcatggatgtattgaactgctgtacagaagctcccactccttgaacagcatgaacgaccgtgttcagcttttctgatttttcctgaatatcttcagccaggcggttggtcttatgtaaaagctcggctgtttcagttgtgatgcccttcatttgtccctccagcccttcaagagtggatgcgacgttttttagtgtcagctgcaatgacttcaatgttttagacaagtagatcactaatacgagaaatgcaactgcgatgagtgcaacgcttaaataaagaataataatcatctcaaacctccttgctgcaggatatactgctgtttacccgttttcttcaatcataaacatgtgtactgggctgtatacatactattctccgttatgtaagaaaatcctttaataagcttttccatcagataaataaaaagcagtgagatcactgctttttattatgccatgacgttttcgtaggctctcatatatttttggatatctcctgctcccatgaagatgagaacggctttatcatgagcttttaaaacagatgtgtcatcttcttcaatcagcttggcattatgaatttttccctggagatcgccgatcgtcagctttccggcattctcacgggctgagccgaaaatatcgcataaatacacacagtcagcgccgctcaggctttctgcaaattcgtcaaggaactgctgcgtccgcgtaaatgtatgaggctggaataccgcgacaatttcccgatcaggatatttctgtcttgccgcctcaattgtcacttttatttctgtcggatgatgagcatagtcatcgatcagcacttgatccccaagctgcttctcattgaatctgcgtttgacgcccccaaaggatttgagagcatgcttaatgatgctggaatcaatttcttcataatggcataacgcaatgaccgccaatgagtttaatacattgtggtggccgtacgcaggaatataaaacgtatcatagaacgtattgcggacaaagacatcaaaagttgtcccttccgtgctttttacgatgtttctggcttgaaaatcattttcttcccccgtgccgtaatacacaaccgggacgttcgcatggattttcggcagatgctcatcgtctccgcaggcaataatgcctttgttgacttgaagagccatctcttggaaagcgtcaaatacatcgtcaatgcttgagaagtaatcagggtgatcaaaatcaatattcgtcataatcgcataatctggctgatagcttaagaaatggcggcggtattcgcacgcttcaaacacaaagtattcgctgttttcatttccctggcctgttccgtctccgattaagaaagacgtcggttttgcgttttggatcacgtgagccagcagacccgtagtcgacgttttgccgtgtgcgcccgtaacggcaacactcgtgaattttttcatgtagtcgcctaaaaacttatgataacgtatcaccggaattccctcagacatcgctttttctatttcaggatgcgtgtctgggaatgcgtttccggcgatgactgtcatgccgggtttaatattttccgcgctaaaaggaagaatcgtaatatttcttttttcaagcgctgtttgcgtaaaaataaatttttcgatatccgatccttggacagtatatccattatcatgaagtatttgggcaagcggactcataccggtcccttttattccaacaaaatgataaacagtcataattgtacctccaacaaacgtctatctgttccccagtatatgacgctcatttcaatttgcgaccgcggcggctgaaaagcctcccttagcggcgtattttatatgttttgttatgtttagtatcaggttatttctttccgattaaacccagatatcaagatttgtctatgcacagctgctgtaaagcggcatagctgttaaatgctctaaacactatcataccatgtttggtgtgaaaatgaacccatattattcgtttattaaatcacttgctgtgatcagcacctctcgaggcttgcttccttttgcctcagagatcatgccttccgcttccatcatgtcgatcagccttgccgcacgattgtaaccgattctgaatcttctttgcaggcttgaagtgctcgcactgttttgctctacaacaaactcacacgcttcgtaaaacagttcgtcctcttctttcagggctgatccttgtcttacgagctcttcttgttcaaataaataggtcggcggcatttggcttctgacgtgggaaacgacgcggtcgatttcccggtctgacacaaagttaccttgcagacggaccggttttcccgatccgttttccaaaaagagcatatccccttttccgagaagcttttctgcaccggctatgtcaataattgttcgggaatcaacctggcttgagacagaaaaggcgattctcgtcgggatattcgccttaatcaggcctgttatgacatcgactgacggacgctgagttgcgacgagaagatggataccgcacgctctggctttttgggcgatccgcgcaatgctttcttccacatcgtttggagccaccatcatcaaatctgctagctcatcaataatgacaactaaatatggcagcttttcacccatttggtgttcagcggttaattgattaaagcggtcaatgtcgcggacacctgaatgggcaaaaagctcatagcggcgctccatttcctcaacaacccattttaaagcagcggtagccgctttggcgtcagtaatgaccgggctgacgaggtgaggaattttattgtaaggggccagctctaccattttcggatcaatcagcagcacctttacctcactcgggtcagctttataaagcaggctgactaatattgtattgatgcatacgctttttccggagcctgtagcgccggcaatcaagccatgcggcattttcttcaagtcgataacaacaggatttcctgaaatatctaatcccagcgcagctgtgagcggtgacttgcttgtcctgaaagctgagctgcgaatcatttggcgcaaatcaaccaccttgctcgtgcggttcggcacttcaattccgatcgtgtttttccccggaatcggcgcttcaatccgaatatctctcgctgagagactgagtttaatatcatcggacaagttggtgattttattcacctttacacccggttcaggatgcacttcaaatctcgtgacagacggaccctgggttacatggaccacattggcgcggacattgaagtttttcaaggtcaaatcaagaagctgacgctgttcttcgatccacgcagcatcatcttgaacctgcgctggcgggacatcaagcagtgcaacattcggaaatacatagctgccgcggcgctcctctgctttttgctgtttatgcgtatctcttttcagcatcatcacattaaaaggaacggatggccctttttgagaagatgcgctttgttcggtccttttcgcctgtacaccaggcctttttttcggctcttctgaagcttcgcgaggtttgtctgcgcgaattccctgccggttttcaagagttgcagtaaacgatttggaaccctgctccatgtgttcagttttcccaagctctgtatggctgtctggctgaacatctatcttcgtttcctgagcctctctcaggatgtcataatgattatttattatgctgtctgatggctcttctgattcttttgccacagtttctgctggagccagagcctctgatgaatactcatgatcagtaaataaaggctcttcctgacgaatgtccatttgttcttcttgaacgaacggggactcagcaccttccgccacgttttcatgatgattgtatactgggctgtctgacggctcttttgctttttcatcctcagatattgcctctgtctgagattcaggagctgtttgctcttcatcaagttcagcggagaaaacaggctcttcaaatgtctctgactgctgctccctttgttcttcctcagccgttgcaggctcttcgcggcctacttcactgtctgaaagcccttcagccgccgtatctgtgagcatctcaggcggtgtttgctcttcggcatgttcagttgggaagaaaggctcctctttttccggctgttgaacgcctgactcaaatggcactctgttacctgacggctcggctggccgtttcgccagcgcctcatcatgctccgtatcctttctgtttaaaacgccagaaggctgttttttaaattgggtatccgggaagaaaggactttcttttttgtgtgtgtctgaagcaggatagccgcgttcacgttcgatctcttctgacagcagtgttaccttctcttttaccgatttatccggttcgttcaatgtttcagaaggctttttcggcacatcctttttaacagatggtttttgattgaatccatagacaggcgaagggatatttgtcggtttaaacggtttcttcgccggctctgctgcttgatatgtatgctgctcttcttcatttctgggacgctctctgtaaggtgcagcacttggacgaggcgcggatttcggttcgtccgatggtgtgcggcgccttctcaggtcatgatttttgtatccgtcaggcacgactggaaaacggaatttgccttttggatattcataatatattttaggatcttccaatctttttaattgtccttcaggatgatgtacttcttgttgctgcggaatttgagcgggttttgtctcccgttcagcatcctcttcgctttcgcctaaaaacaaatcaaaaaatttatgaagccaactcataatttatctctaactcccttatagttttctgggacggtttttagtataccactgctggtcggcccagaaaagattaagctatcagcagaaacaaagccgctaaacaagggcttagcggcttttcacatgattcgttttttttggcggatttatgggagtctaaaactgaaatgcgtctcccgcctcatagtctccttctaacacaaggattcctttttcagcaggggcatccggcaaatcaagctctttcgctgagcagatcatcccgcttgacggaacgccgcgaagctctgcatccttaatgacaagtccgctaggcatcacagcaccgactttggcaacgacaactttttggccttggtcaacgttaggcgcgccgcagacgatctgaagcgtttcttctcctacgttgactttacatacgcttaatttatccgcattcggatgtttttcttttgactctacataccccacaacaaacttcggagataaatcaacgactaatgtttcttcaacgccgtttctgtttaaaatctcattcacatcttgcacgaatgtttctgagagcgcaacagggccgttttcatcaatggtcaagtaagaagacgcgttgaaaatgttgaagcccgttgtttcttttgtttcgttattgaaaattttgacgacgtcgccgtgtttttcatagcctaattgttcgcgtgtcacatcttgaagagagatcaggagcgtgtctcccacaccttctttattataaaaagcgttcataaataaaaatcctttctaatcctttttcggacggcttttcgccaggataaacaccggttccagctttccttcattgtacaaaaatgaaagggcggtaatcgggacggtgccgcctgcaaagaagctcatcgacatttgtcctagaatatcataccccgattcattccggatgtcagcaagaatcaaaacgtcctgatgaggaacagagatcgccagctcaccttctgcatgctgcttatattcatttaagatcgcttcgttcaaaatccggcttgcgtcgtatccgtcgtttgccctgaagaaataaaagtaattgccggcaaccgtatcctctttgacaaccgtcggcagggaacggagattaaatgcggccgtctctctgatcctctcttttgtccagttttctttctcaagcatgcgctggtcaattaaacggtaggttttcccgagatctagcgcgtaataaattcttgtctctgcggtatgatcgtcataaatgagcgggatatcttcgctggacttgtccgggaaggaagtcgagcggatgaccggataaatgcgagtttctttcccggtcatttcctgagccttcccttccattgccgtcatcgcttcggagacatagtacacgatctcatcaatggcttcgtcttttttcagttcccattttgcaataatcggcggcaaatcgagcgtaatcccttttttagtcgtttgatcctcaacacggagggtgtctttttctctgtcaaacagaaaggagcgattctcgtgctgaaggcgctgtttcagtatatctgacagcttccttgaggtcattttcaaaccgatgtcctcctttacgctttagcgagagagtctgttaaaaactgttcaatttcttcttttgttttgcggtctttgctcacaaaacgatttacttcttttccttcattaaacaccacaaagcttgggattccgtaaatttcccactctgcacatgtatcaatgaatttgtcacggtctacgtagtagtaggtgaattcagggaaattcgcttccagttcaggcaggaaaggctctacaaaacggcaatccgggcaccaatcggctgaaaacataaatacagaccaatcatcctttaccgctttttccagctcttgagttgattcaatttttttcatttcatatccctccagttgtttatgttcttacatgttttttatcgatactcgtccatttggatcataccaaactgcttgaggcaaaaccacttatatgcaacgaatgaatatgtaagattggctttcccattatcattatcatattttatttgcattatcaagctcgtttcgtttaacatcgtgtacatgagggtgaaatttacagatggatatacataaggagggatttttattatggagtttatcgtctatttagcaggagaaatccacagcaattggcgcgaggaaattaaagaaaaaacaaaatcactgaagctcccgattacgtttgttggcccgatggagaatcatgaccgctcagacaatattggtgaagaaattatgggcgtacagccaaatgccgttttaaaggatgacaaagcctctgacatcaacaacttcagaaccgccgtcctgatgaataaagcagactttgtgatcgccctgtttggcgaaaagtacaaacagtggaacacggcaatggatgcatcatatgcgatcgcaaaaggaaaacccctgattatcatccggccggaatcgctccaccatcctttaaaagagctttccaataaagcgaatattacggttgaaaccgttaaccaagccattaaggccctttcctatctatttgaaacagaataggaaaaaagcttgtcgatccgggcttactgctcgttcaacaagcttttatgaaacctacatattttctttaatcgcatccactgtctgcttatcgcaggctgttacaagtttgatgagcatttctttagcagcagcataatcatcaatatgaatgatagaagcgtttgtatgaatatagcgggaacatattccgataaccgctgacggcacaccgctgttcgaaatatgaaccttgcctgcgtctgttcccccgccggatacaaaatattgatatggaatatcatgcgtttcagccatatcaagaacgaattccctcattccgcgatgcatgactgtcgttctgtcaagaatgcgcagcaaaaagccttttccaagctggccgaattcatttttgtctccgctcatatcgtttgccgggctggcgtcaagggcgaaaaacaagtccggtttaatcatatgagaagccgtctgcgcgccccttagccctacttcttcctgaaccgttgcacccgcatagagtgtattcggaagctctttaccgtgtaattccttcagaagttcaatgcttaagccgcatccatatctgttatcccatgcttttgataaaattttcttttcattcgccatcgtcgtaaacggacaaacaggcacgatctgctgtcccggtctaatgccgattttgatggcgtcttccttatcatccgctccaatgtcgatcatcatgttcttgatatccatcggacggtttcgctgcgcatctgtcaataaatgcggcggtatgcttgaaatcacacccggaaccggcccgttatctgtttgaatttcaacccgctgcgcaagcaaaacttggctccaccagcctccgagcgtctggaatctgagcagcccgttgtctgtaatggatgtcaccatgaagccgacttcgtccatgtgcccggctaccataattctcggtgcgtcctctgcgcctcgtctgactccgaaaacacttcccagtctgtcctgaacgatgtcatcggcatatttggctagctcctgcttcataaaagcacgaacctgatgctcattgcccggcgcgccgggaagctgcgtcagtgtttggaaaagcgctttcgtttcttgattcatgttttcccctcatttctatgtagtccttttattttattagaaacaatgaagttttccaagcaccctgaccgaatctgctcgatcagccgcgtattgcttaacaggatttggctgtttctgtataatgaaaagtacgatcaaccaggaggtgctttattttgaaattgcgtcatcttcttttaggagcaggacttggaatttgtacggctgtcgttgtgaaacaatatgtgatgaagccttatatttcttcagaaaaagcgcttcgaattgtaaagtctgcttttaagcagcggggcccgattgacggatcatggatttatacccagccggagccctacaatattaacggagaaacggtacaggtatacaaaaccggcattacacgatcagctttcggagaattagaacagtatgaagtcatggtggatgcgaaaacgggagaaattgttgatgtcattgatacaatcgcctcttaacaccggacaagcaaaaaatagaagccgctgcctacgcagcggctcttttttattatatcgcgcgaatcggtttgtataccggataccacatcgcatcctgcactgcctgtataatgtcttcaggctcttccgtagcgacgccttccttcattgcggtttttgcaacttcaacagcaacggttgccgaaacagtgcgcaaatcttcaacttttggaagcatcggcgcgccaggcaccccgacattgaccatacctgcgattgcccgggcacatgcttcaaacatgccgtcggtaattaattttgatttggtaacaatcgttccaagaccgagaccagggaagacaagcgcgttgtttgcctgcccgatatgatacgtaactccgttatattcaactggcgggaacgggcttcctgtcgtgatcagcgcacggccttctgtccattcgattaaatcctccggctttgcttcagaaagagttgtcggatttgacattggcaaaatcgccggccgtttcacatgtgacgccatttcttttacaatttcttcagtgaaagcgccggaaaccgtagatgtgccgatcaggatcgtgggttttgcctgccggaccacttcaagaagatcaatgcctccgccgtctccgttccgctgataatccttcacttcttcagccgaacgggcatacggcttttggaaatcaagaagctgatccatatcatctgttaacagcccgtttctgtctatgcaccagaagcgcttgtatgattcttcttcactcagtccctcgcgcaccaatgcttcccgcagctgttcggcaattccgattcctgccgttcccgctccgaatataacaactctgtgatctctcagcggaactttagacgcttttgcacaggataagactgcggccaaagaaacagcgccagttccttggatatcatcattgaaggtacacactttatctttatagcgtttcaaaatgcttcgcgcgtttttcgccccgaaatcctcccaatgcagcaatgcattcggaaatgtttctctcgccagcgcaacgtagtcgtcaataaattggtcataacgttccccgcgcactctggaatgctggttgccgacataaagcgggtcgttcaagaggctctcctgatttgtccccgcatctaaaacaacagccagcactctgctcggatcaatgcccgcagccgctgtataaaccgccagcttgccaatagaaatcgcgattcctccgacgccccagtcaccgattcctaaaattccttccgcatcagttgcaacaattaaatcaatcgtatcactttgatctttatactgtttaaatgcttctttcataccgtccgggtcatcgattgacagatagagccctcgtggttttctgtattcatggctgtatctctggattgccgttccgactgtcggtgtgtagacaatcgggagcatttcccctaaatggtcatttaacaggcggtaaaacagcgtttcattccgatcgtgcagcgccgttaaatagacatttttgcttaaatcgtcaggctgtgcggaatattgttcatacgctcttttcgcctgatcatcaattgttaataccttgggcggcagaaagccttttaaaccaagttcttttctttcttcctcagtaaaagcaacacctttgttcaaaaaaggaacagagagcacttcaaggcctcttaatgttgtttgaatgtctccttcgtttgttactctgaattgtttcaccctgcctcttcctttctgagcataattagtactaggtttgcattattagccggaaaacatgcagggtaaacataaaaatatgctattgcttcattcgcttaactgactttttgatgcttccgtcctcctcccattgaagggcgcgatactcggcatcatggtaaaaaataaaccaagcgtctttttctgctgcgaacgcctgccatttctgcttttgcgggatagaggtcatcggataatcatcgtaagccagcacccatagcggattgcggtgggcatgtgtcggcatcagatctgccatatgtacggcagtttcacccgcatcctcgcatatcaggacgctgtgtccgtcgctatggcctccggtgtgatgcattgtaataccctctgtgatcgttaaggtgtcttcaaaggttttgacttggccagctacagcctcccaattttctttccaatacgtatttttcgacctgatattcggatggcgcatttcgtcccattcaacagctgatgtataaatcactgcattcggaaagacagagacgagccgttcaccttcatattccgttaaaccgcatgcatgatcaaaatgaaggtgtgtcattgcgatcacatctatatcggcaaccgttaatccgagtgctgctaatgatggtttcacattcgactcttgtgtcacgccatagtttcgtttttgtttatcagtcagcttgccgtacccaattccggcgtcaacgatgatattgagcccatccttttgaatcaaaatagggtctgtccttagttcaatctggtttttttcattgactggatattttttagaccatagcggctttggaacgacgccgaacatggcgcctccgtccatatgcgtcacgcctccgtcaagccaggtcaacgtgatgtttccaatcttcattgtttccattttcatccccctgtcatcatggtagcaaacggcccataaaaaaaacagactcctgtcagagtctgtctttacgttctccattcaacctcagcccgatagatcggctggccgagtgcagagaatttttcttcatattctgtcataatattgccttcgagattgctgttatgcaaatcgaggctgacgtatgtcagcaggaggccgtactcagagaagctcttcaaagagtactcaaacaaacctcggttgtccgttttaaaatgaatcgatccgcctttgcccattacttcttcatattttttgaggaagtgggaatatgtcaggcggcgtttttcatgccgtttcttcggccaaggatcagaaaagttcaagtagacccgtttcacttcccccggctcaaacacatccgtcagcgtgtccgcatctatattcagaagctttacattctgcgcttcgctgtcttttactttttggacggctgtcacgatgacgcttttaaataactcaataccaatataattgatgtcgggattttgtttggccataccagaaataaattggccttttcctgtaccaacctcgatatggatcggattgtcgttgccaaacactgtgttccatttccctttataatcagcaggattgctgatggcaatatctgcgttttcagccaaaaagtcatcagcccaaggcttgtggcgcattctcatatgattgacacctctatctattatttcgactaacaacataccatgaattaaaaagacccgcaagctcgtttttccagtgtatctctcttaaggccgagcgcataaaaaaagagggtcccgtctgctggaacactcctttcacatgtataaaaacgctctgttttgaacaatttaacccgtatgatactgaagggatgtgtaccgttatgggtttacattatgagcatcaagttcatttattgaaggatatcttgactgaccatcaattggactgctgcggaacagtcgcagagtacgagcagcttgagcgtgtgattaaatcactgatggcaaacaccgagcttgattcaaatttcaaaaacgtgcttgaagatgtttaccgctacagccaatcaggaatatcgtccaaatccatcgactcacacatacaagagcatcagaacagcctgtctcaatgggtagagcaaatggattcgtattcctgattaatcaacaattcgtttcatgaggatatgcagctcttccattgcatcatgaaattccttgtcattgccttttgctttatgccaggcaatgaaagtaattgtttcagataacacataccaagccattcgcaaccgaaggctttctgtcagctctatgccgtacatgctcagccagctctcccaagctggcttttcgacgtagtggtacagcaaaggcccgaggtccatcgccggatcagcgatcatggcgccgtcccagtcaattaaatacagctggttgtcttcagacaatagccagttattatgattgacatcacaatggcaaacgactttctcaccgaaatgcacttcatgcaggtgttcttccaaatacttgatcccttcttgaatcagcggcgaagattgctgcacagcaaatacagcctgcttcagctgagacaaaagagcccccgggttcagcggttcttttccaagtctcttcagcatgtccagcaaggcttttgatgtgtgtattttacgaagcaattcagcaacgggccttccgctcatgtctttaggcttcagctctctgccggtcatccagtgctgggccgtaatgacgtccccattttccatccgttttgtccaaaccagcttcggaacaatgccttcggcggataaaacagctaaaaaaggtgagctattacgttttaaaaaaagctgctgcccgttatgtttcgcataatatgcatctcctgtagctcctccggcggggaagatctcccaatcgctacctagtaattgtcccaaccagttcatatcaatgttcaacccatcatttcttaaaatattttagaattaaggctaatcgtctctagtctatccagcgaatgcctttttcgtacgaatcgtataaaaataaaaaagacagctattgagagtctcatatgctaatcaatagccgtcctttaaattttagcgctatagcacaaacttcgtcaagcaaaactcttaagatctgatgctaaatataagataaccgttccgatgccgtttactgcaaccgttttcttgatttctgttgggtcttcctgaaatcctgatggatcacataaaagccgataaggtatgtcgtttggcagcctccactcgacggagtctggactcgcgtgatggataacaatgatatctttccattcgtcaacctcgtcaagatcataaagcctgtatgcgataaggtgttcttttagcgtcaagcattcaagatggcgctggatgtctgcagcggacctaagacggaatgcaggatgcgcttttctcagcgagatcagcctgcggatatagtgaacatcttctttgaatgtttcacggcgatcccagtcgagctggttgatgctgtcactggattgatagctgttttccactccctgcttcgtccggaaaaattcctggccgctgtgaataaacggcaccccttgggcaagcaaaataatcgcggctgcaagcctttgcctgcttcgctttcggctgtcattttcttgaggaagcgcgaagctcattttatcccaaaaggtgtgattgtcgtgtgattcgacataattgatggactggcttggttccggaacaatcggtgctaatgccttccatccggaagacccggcaattccatgcatcacagcttgtgctgattcactgctgccgagcgcaaaccctgctgccataaggtgaaaggtgttcccttttacagcgtcacgaaacatatcattaaaaaaaccgatgcccggcattcttggcgcgttcgccaaagcagctttctgttcatgcggcagcggtgtagacagatcccacccttctccaaaaagcaggattccgggctttgccttagttgctttctctttcatataaagcacggtgtcaatatctaaaatcccgaggagatcaaagcggaagccgtcggcattgtattcttcaagccaatagaccacgcaatccgcaatgaattttcttgccatccttctttctgatgcaatatcattgccaacgccggtgccgtttgacggcatcccacattcgtcgtgccggaaaaaataacctggcactgtcttttcaaagggggaattctccctcttatacacatggttaaaaacaacatccagaatgactcgcagaccgtgctgatgcagggtattgatcatttgtttcagctctgtttttctcgtttgaggatcatgagggtttgaggcatagcttccctccggggcaaagaaatgaagcgggttatatccccaattgtatgcatcaagcggcttctcttcatcaactccggcaaaatcattcaccggcagaagctccacatgtgtaacaccaagctcttttacatacgctagtcccgaagaactgccatttgcggtttgtgtatcagtttccgtcagcgctaagtattttcccttgtttatcatgccgctgttttcatggatggagaagtcacgaagatgcgtctcatagatgacggcatccacagggtgtgagaatggtttaagaggagcagtccatttcatttgatccgggcgcaagacgacgcccttctctccatttacagtcacagccttggcatacgggtcaacggtttccatccattctgaattgttgcagatgcaaaacaaatactcatatccgtgaaggtcacctgtgaccgtaacggcatagacgcctttttccatccgagtcatttggaatgtgcgcccgcttttattggggtgtgaaagcttgacagcagctgaggttgcagcaggcgcccatactttaaatacggtatgatccgcggtataaacggcgcccagctctccgtcataataaaattcgtcatcaaacgctgccgtccggatgaccgcgccaatttggagatccgttttgtggccgctggatgctctgacgcaatggatttttccaaatgtcacaggatggtcggatacgcagacgtacttgtattttgcttcaagggagtattcctccctgacagccagaggaaaatctgttatttctgtctcaagccgaaacggcggtgtcatgatttccttttgttcagcaggaatcagaacagtaatgatattcatgtcatcgacatacgcttcgaagctgcggcggatgctgaccatcggaagctctctcctccaaacacgtttatgttttgattcttaggggtgaaggactagatgccagacgaaacggggtagtgcccatgatttctccgtcagcatggaacgggattttgtccttcgtgtaaaatgtaatgtccttcgctttaaacatcgtaacgccatccatctttgtatgttttccaaatgccatgagacataaaagccaatattttttcaaaaacggctggttttcaacgattacgatatcaaatgtcttctcgcgcggatttgctaggggcgccgccttcatgcctcccccgtaaaacggatggttggatacaacggcaaaccagacatcatgaaattcgcgcgtctcgtcttccgtcgtacaagctaacgtaaacggcttaaaggttgccgaagcgtgcaaatgagaaagcggatacacaagaaatcgaaggcggagaaaaagaaaaacccgtctcaacggaaattccatcgcctttttattgacatatgcgtcaaacccgatcccgatatgattcataaaataaagaatctgtgatttatcctgaaggaaattgacgctccctaaatgaaaggttcttgttaacgggcgctttaccttcttgatttcctgtatcagatcgatttttttaatagagaaccctcgcgaaaaatcattatacgcgcccgccggcacaaagctcagctcaatatcgtcaacatctttcagcccgttgacaacttcatgcatggttccgtctccgccaatgacgatcaggcgcttcagcttatattcctgtatcgttgaaatctgtctggcgagcacctcggcgtgtcccggatgttcagttaaaaatgaacggtgctcaacctttcgtttgatcaattctttttgaatggacttccaaacacgcaggccgtttcgatgtcctgctgtcggattaataataaaaaaccaatggctcatctttctcacctgcttatgttatgagaaaaccgctcaaatcgttctcttttactccagccactcctgtctgcgataggagtcagacatgcagtaagacaatagagcctttgcagcctttacctgatgatgtttgatcggagcagtgtttttcttctgccgctcaatccattcttccgcgctccgcttatccgctatttctaagccgtatggcggctccgggtaatcgatgtacgacgttctgctcagaagcaattttcgaaccggaatctcagcctgtttttcctttacgatctttgacacaaccgagtccgtacgaaacaggctaagccctggatttaacactgatgcagtctgagaggctgttttcttgtcccaaaaacgatttttagaccctatgtagacactgtcttcctcagcctctaaaaaagaaacgcaataaatttccagaggagaaataatcacaatgcttaattcaaccgccgcatgctgaattttcagcacaggcttatacataataaaataagaatcaggcagctgctgggtcagataacgcaaaatgcggtcctgcttcacttggtttgagagttgagatatttctgaaagagtagagcttgcccatttgagctgaaaatcatataaatgccttttataaaaagaagcaagcgccaccctgctcttcgggagccttacatgaatatcttcttcgtcctcaaaccattggtgtctctcttcttgtatatcggcttttatctcttcttttcttcttttcaatgaaaatttttttcgtttctgcaccggttccggttcttcagcactggcttgcctttcttcatgctggcgctccgctgcttctactagtgaaagccagcgctcttttttcagacgtacaaactggttgatataatggtacggatcaagctcatatctcgatatataatcatgaattttgatgatttgtgccatgtttgtttctccactccgcaatgaattaagataattgaaatttgaatatttcctcgtattttggtgattggttcaagtgtatttgaaagagcgaaaatcgttcagccatcatcgaaacctcgccgctttcaaacggaacatgagctggaaatccattttcgcctgtccattttcttgccagcgtcatatgaggatgatacggtcttttttccacttgaaagccggcctgaaggacagcctgcttcgtatgttcccgcagtctatcaagcgttttgtttttctttggctccagatgtaaaacgcgcggccttctgcggtcgccgaatacatctatcttgtcaaactcaattgaaaatgggtcaatttctgaagcaatctctgctagcgaaccttcaagcttctttatttgtgtctcatccgccgctccgagaaaaattaacgtgatatgatagtcaagcgggtgcacccatttttgaaacgtcaataccggttcgtttttcgcagcctggtagatcggatttgcaattccctcaggtatgggaacgccgatgaaataatgaggccgtatatctggcatccgtctgacactcccttctttgacagctattattttatcaataaagaggctgtgcggatagaggaacagtgtatgaaaacactctcgcacaaacgtttattatgttaggatattatatgacacttgttttattcagaaaggaatgacaatgttgaaaatcgttgcaaacacagctgatctgataggagatacaccgctagtgagattgaatcggcttcagccggaaaatgcggcacaagtctatttaaagcttgaatttttcaatccgagcggcagtgtgaaagacagagccgcttatcaaatgatcatagaagctgaacaaaacggtttactcaagccgggatcagttattatagagccgacaagcggaaataccggcatcgggctcgccatgaatgcggcagcacgcggatataaagcaattttagttatgcctgatacaatgacgaaggaacggatcaacctgcttaaagcttacggcgcagaggttgtattaactcccggagaggaaagaatgccgggcagcatcaaaaaagcgaaggagcttgccgaacaaattccgaacagctatattccaatgcagttcgataacactgccaatcctgatgcgcaccggaaaacaacagcgcctgaaatcgcccgggcaatagaggaaatcggaaaaccgctcggcgcttttgtcgcctcctctggaacgggcggaaccattaccggaacaggtgaggcgctcaaagagctttttccggatatcacggttcatgttgttgagccagcgggttcgcctgtattatccggcggaaaacctggcgcgcataaacttgtaggaacgagcccaggctttataccgccgattttaaatgaagacgtttatgatgaaattatcaaaatctctgatgaagacgcgtatacgacgacaagacggcttgctgctgaagaaggaattcttgtcggtccttcatcaggcgctgcctgcttcgcggcaatcgaaacagcgaaacgcctctctcctgacaaagttgtggtctgcatgacagctgatacaggagaacggtacttatcaactgatttatggtcatttatttaaaaaaaggactggcttcagcagaagccggtccttttattttgcaagctcgtaaatggcctgagcatataacgctgtcgatctcagcaggtcatcaatttcgatatattcatccttttggtgtgcgctgtcagggcgtccggggaacagcgggccgaacgcgacaccggcttttaaggatctcgcatatgtccccccgccgattgagattaagtcagcttttttacccagctggccttcataaaccttttgcagggttttgactaacggatgatctgcggacacgtgatgcggcttgctgtctttgaattctcccagctcaaattcagatgcgctttcgaatgtatcgcggatcactttgctttctgctgtcacaggatagcggatattgatcccgagctcgcctccttgcccttctttatagcgcagtgttccgacatttaatgtcagctctccgctgatttcatcctcacagtcgatgtccagtttttttcctcttgtatcacctgagaacttatctgtcacaacttgcacaaaccgctttcctgcatcgtcaagctcagtctgctggagaaattcgcacaataaaatgccggcattgatcccattgttcggttccatcgcatggcaggaaagaccgtacatacgcaaaatgagctgtccgttctctattgcagcttcccctttttggtccgtcgtgcggagcatgtctttaaatgaagacataatctcttcttttttcagcccttcaatgacagcttccgcagcgtcaggcaccatgtttaagcgaaggcctgattgaaacgagacaagcactgcctttggttctgcttgatttgggcggtgcggaataagtaaagaagcatcgatgatccctttttccgcattaatgatcggaaaatcggcgtcaggcgcaaagcccattgttggcatttcttcatgcttgaaataatgctctacgcatctccaatcactttcttcatctgttccgataatcattctgactcgcttggacaggggcaaattcatgtctttcacgattttcagcgcgtagaatgccgccattgtcgggcctttgtcatcaatggcgccccttgcataaatccgtccgttgcggatttcagctgaaaatggatcactcgtccacccatctcccggcggcacgacgtcaacatggcaaagtacgccgataatgtcatcgccctccccccattcaatatgacctgcgaagccgtcaagattttttgttgtaaagccttctttttctccaagctccagcaatgaagtcaggctggcatttaccccttctccaaacggtttaccgggtccggcggttgtttcgtccatgacactgttgattctcaaaaattcctgtgtatcacgaattaaatcctctttttttctgattacttcaacttcccagttcataatgatcccctttccgcaagaaatgacttgcaaaaaccaaataaaacgaataatattaatggtgttttgttaaaacgttcgtaattggaggatactatgtttcatctaaaagagcagcaaacatccataaagcaagaaatcatagcagggctgacgacctttttcacaatggtctatatcgtcgtggtcaatccggtcattctggctaacgccggggttcctttcgaccaggttttcaccgcaacgattattgcctccattgtcggaacgctgtggatggccctggcagcaaattatccgattgctattgcgcccggcatgggcttgaacgcttatttagcctttcatgtcgtaagcgcaagcgatggcggcatcacgtacgcaacagctttcagcgcagtatttacagcaggggttctcttcattattctatcgttaacgcctttaagaaaacaacttatagaagcgattccaaacaatttaaaatacgggatcacaacagggatcgggctgtttattgcttttatcggtttgcgtcaagcgggaattgtggcagctgatgagtcaaacctggtcactctcggcaatctgcattcacctggtgttatcttaacgctggtcggccttttgatcagcgtggtcctgatggtgctgaatgtaagcggcgctttatttatcggaatggcagctaccgctttgatcgcctttttcaccggtcagctccatttttcaaagggatttatgtcgcttcctcatttgccggaaggattgatgatctcaaatccatttaccgcttttggcgatgtcattcatcacggcctgtacgctgtcgtcttttcttttctattagtcaccatttttgatacgacaggcacgatgatcggagttgccgagcaagccgggctgatgaagaacaacaagctgccgaacgtgcgaaaagcgctgcttgctgattcaaccgcgacgacagtaggagctgttttcggcacaagtccaacgactgcatttatcgagtcttccgccggtgttgcagccgggggaagaacggggcttacggctttgactgtcgcggtgatgtttgcggcttcaatgtttttcagtccgcttgtcagcgccttgtcaggtatagccgccatcacctcgcctgctttgattatcgtcggcagcctgatgatgggctcagtttccaatatgaactggaaagagatggacgaggcatttcctgcgtttctcgtcattctagccatgcctttgacctcgagcatttctacaggaatcgcgcttggctttatttcgtacccaattgtaaaagcggcgcggggaaaatggagagagattcatccgctcgtcatcgttttcgccattctgtttttcatccagctgtttattttataaggatagaccagaaaacccaaacgtcgccgtttgggttttttatgtaaacaataaagagacagcggccgctaaagaacaacaggcggcaaacgcatagtgcaggatgttgatacagctttttctggcccgataatattcatcactttccttatcggtgccaattaaaaaaggggcatccatgaccttgtcaaaaataagcgtcaggatataacggcaaacccctgtgtataccagcagcgcaatcaccttcagccaaattggggaaacaaatatgagaacagtgaaagctgacagtagcatgtacatctgccttgcatactcgccattcctcagcataactttaaaaaacaactccttatagcctgtgcagatcgttcgtcttttaaatatcctttttgaatttcggtataataatggttttcttctcatcctgtcttttacttttggcattcccgcctcctgactcatcatcatcacaagtcctgcaagggcaagcctgctttttttctcttcagtcacctcagcttcaaaagccgtgaacgaggctgtctttttcaaactgcggataactgagaaaaacaaaaataaaatgccaataagcgcaagcaagtgccactcagtaaaaacaatcaggatagcagaaccagcaaaaagaatagctctgacaagggtatcgccaatccatctcgaaatagagcgcggctttctgatcctgtcttgctttaaggataaaaagaatatatgaaggccaaacaaataacacaatagagcagtgctttctgcgaatgtgatgtgaacaaaatgactgataaggggaaggacaataaaaaagagaagcagccatttagccagcgtgaccagaaaagaatacaaaagcgtgtaccgtttgagctgatagatgatttctttcttttgcagcaaaaacactttgtccgcttccattaaaaatgtacgaatcgaacctgtaaacatgatcagcacacacacagcatacagccatctccattccgccacttcagaccactcataaagaaggcctcttccgttcatcaaatcaatatactgatagatgacaaaagcaatcgccggcaaaacgatatagagagcgactgtccagtcaatgaccgcatgcaacactttaaactgatacttgtaatagtcaaacagccttcgaaaaaagagcgtacgcccgttcatggccgatcaccttgaactgccttataaaaacagtcaagcaatgactgcccctctaatccggtcttgtcctgaatatcttttaacgtgccttggagaaataatgaacctttctcaatcatataaaaccggtcacagattttttccgcggtatcgagtacatgcgtgcacatcagaattccggctccacgttctttttcagccttaagcatgtccacaaagcgtttcgtcgatatcggatcaaggccgataaacggttcatcaatcacatacatatccggcttagagagaaaggcctggataagcattagtttttgctgcatgcccttcgaaaaggtgacaggcagctcatgtttgacatgatctagcgaaaacgtctgcagcaggctttgggcccgatgcgcaaattcactctcttcaatgccgtggagtgtgctgatcagatccaaatgctcccacagcgtcagttcttcgtagaaggacggatgctccggaatatatgcaaatgaacagtcgttccaggcaatatgccctttaaaatcttctgaaaggccgagtatcgccttgattgcggtgctttttccggcgccgttggctccgatcagtccaaccagttccccttttctgacttccagaaaaacatcggtgagcactttttttcggcttgtatacccggcctgttctattgaagcttcaagcaaatttgtcaaaactcactcacctccaaaatttactacgaaacagaataaaaaaagtttctttaaccataataatattgagccgaaatacatagtaatccaacaaggatggctgcccaacgcgaaattggaaaaaattaataggagttatccctagattcatcactgcaatatcgtgtataatgagggcgaattattttaacaattacagatgtctgcctttgttgctatttcgtacgcagttgatagtcgtgagttgtggttagtcaagtccatccgatcttatgatagggagtggttttttgaaaccttcaacaaaccgtatgctaactcgaatcaaatcagtttacatgtttatccaagaaaaaggtcttgtgacaacacaggaactggttgacgaattcggcattacacctagaacgattcaaagagacttaaatgtgttggcatataatgatcttgttcatagtccaagccgtggcaagtgggagacaacgagaaagaaagtaaagattacctcataaattgaaaaattacatagggccgcctgagagcggtccgatagataacagggcgaagaaacctactgagccttgtttttgtgtgcttataaataaaaccccgcattcggtatgcggggtttttgtcatgcttgcggctcattgagcaaatgaagctcttcctctgtcagctcacggtattctccgggtgccagggccggatctagggaaacgcgtcccatcgaaagccgcttcagataaaccacttcattgccgactgcctttgccatttgcttgacctgatggtattttccttctgtaattgtcagatatataacggtattgccactgtcgtttgttttgatttccgcttttgccggctttgttttatagccgccctctatgtagacacccgtttccaaatcggaaatgtcttcccgagaaatctgtgattttaaatggacttcatacgtttttggaacatgctttttaggagaaaggagccgatgtgcgagctggccgtcatttgtgagcagcaaaaagccctctgtatctttatcaagcctgccggccggaaatggctcaaatctcatctcctccggcgtcagcagatcgaccactgtttgctgccggctgtcctcagtcgccgacagcacgccctgcggtttattcatcataagataaatgaactctcgataatcaaccggttccccgtatacggtcacctcctgcgtatcaggatcaacgtgcgcctttacatctttggcaggtttgccgtcgatcataacagctccagccttcacaacggctttgacttcttttctggaaccatacccgctgttggcaagcagcttatcaagtctcattcccaatctctcctttataaaagaaagcccgcagcatgcgagccctcagtttcatcatatctagttcatcagcctgcatgtctgcctttccttaagaaacctggcaaacggcggcctaaaattttctgtaaaaatcctaatcggtagccgcaatacaggtagactgctccgccaacagcggccgcgatcaccacaacaatcgcagcttgcagctggccatcctgataggaaataaagaagcctaatacccactgcacgattttcacggcaatacccataatggctgataagaccagcatcaaaacagttcgtttaacaagtatcttatacgaatagcctgcatggcgcttaatcatgataaacccatataaaagggaagcgatatatccaagcgccgtcgctaaaatcgctccgtcagcctgcatcagtttgatcagcggaacattcagcacaagcttgatcacgacaccgatcacaaggctgacaaccgcaaatttttgcttattgatgccctgcagaatagctgcgttgactgtaaacaaagagaacaaaatcgcgactggcgaataccatagcaaaatgtttgcccccagttcaggatgaaggctctctgacccgtaaaagaacgtatacgtcggtcctgacaatagagagatcccgacaacagccggaataattaaaaacaggatcgtctgcatcgtttgattaatctgctgatttaacagcttatagtttccgcttgtaaacgattcagtaatcgttggaattaatgtcagtccaaaagcagttgctagggaaaccgggatcatcacgagcttctgaacatacagggttagaatcgcaagcatgtcctggctgatggcttgatgaccggcttcaatcatcgctttgttaaacgtatttgtatcaatatagttatacaaagggatggctagtccgacaaaaacgtacggagcagcatagctgaacagctcgaaaaacattttcttgtagcttaggtttgctgtcggacccgtattcggcatcatcgccagcaggctgcccttccgtttgttccaataaatataaagcacgaccagccctccgaaggcaccgatcagcgctgcgaaggttgcatagcccacagcgatgacaaggccgccgttgaaaaccttcaaaatcaagaatgtcgcactcaatagaaagatgatgcggacaatctgttcaacgacttgggaaacagctgtcggacccatcatttggtgcccttgaaagaatccgcggacaaggctcataatcggtacgaccaatagcgctaagcttaccatgcggatgacataaacgacatgatcaattgtcaggccgttattatccttgcctcccagcgatatttccgcaaacatcggagccgatagatacagaatgaaaaaggctatcattcctgtgacgagcataaccgacatgcccgccttgagcattttcctgcttgtctcataatccccttttgaattatatttggaaacaaatttagaaacagcggccggaaagcccatcgtagcaatattcaaaaataaagtgtattggttgtatccgtattgaaataatgcaccgcctgtcgccccgaccataatgctgaagggaattaaatagaccatccccagaatccgcgatatatatgtaccgagcgttaatacaaacgtgcctcttaacagtttgcttgacatgtttcttcatcaccattttctacgaagattcaacttttctattttaccacaactgggcatttagacggtaataaatacaaaagcaatcctgtgaacattcatgtccgcggcaaaagacgtttaaggagcggctttctttcgctataatagtactgcggacggggtgtccgcacacgaaatgaaaagaaagttgatgataaagatgaaacaatatgacgttatcgtaatcggcggaggcccttcaggcttgatggctgcgattgcagcaggagaacagggcgctggcgtgttgctgatagataaaggaaataaattaggacggaaactcgcgatttccgggggcggccgctgtaatgtgacgaaccgccttcctgtggaagaaattatcaagcacatccccggcaacgggcgttttttatacagcgcgttttctgaatttaataatgaggacattatcaagttttttgaaaacctcggcattcaattgaaggaagaggatcacggccggatgtttcctgtgaccgacaaagcccaaagtgtcgttgacgcgctgttaaacaggctgaagcagcttcgcgtaacaatcagaacgaacgagaaaattaaatctgttttatatgaagatggacagacagcagggattgtgacgaataatggcgaaatgatccatagccaggcagtcattatcgctgtaggcggtaaaagcgtgcctcataccggaagcacgggagacggctatgaatgggctgaagccgcgggccataccataacagagctgtttccgacagaggttcccgtcacttctgctgaaccgttcattaagcaaaaaacacttcagggcttatcactaagagatgtagccgtcagtgtgttaaataaaaaaggcaaaccgattatcacacataaaatggacatgctgtttacccatttcggcctctcaggacctgccattctcagatgcagccaatttgtcgtaaaagagctgaaaaaacagcctcaagtgccgatcagaatcgacttgtatccggatatcaatgaagaaacgcttttccaaaagatgtataaagaactgaaggaagcaccgaaaaaaaccattaaaaacgtgctgaagccttggatgcaggagcgctatctcctattcctgctcgaaaaaaacggcatctctccgaacgtatcgttttctgagctgccgaaggatcctttcagacaatttgtaagggactgcaagcagtttactgtcctcgcaaatggcacactgtcgcttgataaggcatttgtcacgggaggcggggtatctgtaaaagaaattgacccgaaaaaaatggcttctaaaaaaatggaggggctttatttttgcggtgaaattctggatatccatggctacacaggcggatacaatattacctccgcccttgtcacaggcaggcttgcagggctaaatgccgggcaatacgcccgttcttaatcattactctttaaatctcttgccgtcaaactcacatttgaacattccccgcattcatgttagggtgagacttgttttgtttcacctgattgcggggtaattttaagagaggaatgagctgccatcgtacgaccatactaagcctgcgagcaagatataggcgtacacaaaaaattagagggtgagaaatgttgaaacatatatctagtgtattttggattgtgattgcaatcacagctgcagctgtattatggggtgttatttctcctgacagcctgcaaaatgtgtctcaatcggcacaagcatttattaccgattcatttggttggtattatcttttagttgtctctttgtttgtcgggttttgtctctttttgattttcagcccgatcggaaaaatcaaactcggaaagcctgatgaaaaaccggaattcgggttattatcatggtttgccatgctgttcagcgcaggcatgggaatcggcttagtattctacggtgcggctgaaccgatcagccattacgcaattagctctccatcaggtgaaacagaaacccccaagccttcagagatgcactccgctatacgtttttccactggggtttgcacgcttgggccatttatgccattgtggcattatgcattgcctatttccaattccgcaaaggcgcacccgggttaatcagcagcacactatcaccgattctcggggataaagtaaacggaccgatcggaaaggccattgactgtattgcagttttcgccactgttgtcggggtgtcaacaagtcttggtcttggcgcaacccaaattaacggcggtttgaattacctgttcggcattccgaatgcgtttatcgtccaattggttttaatcattattgtgacagtgctctttttactttctgcgtggagcggactcggaaaaggaattaagtatttaagcaacacaaacatggtattggccggattgttaatgttgtttatgctcgttgtcgggcctacagtgctgataatgaactcatttacagattctatcggacaatacattcaaaatatcgttcaaatgagcttcagactgacaccgaacgatcctgaaaaacgcgaatggattaacagctggacgattttctattgggcatggtggatttcctggtctccatttgtcggcattttcatcgcccgtgtatccagaggccggacgatccgagaatttttaattggcgtcttggtgacaccttgtattttgacatttctatggttctccattttcggcgtttcagccatggacctccagcaaaaaggcacgttcaatgtagcaaagctgtccactgaaacgatgctgttcggaacacttgatcactatccgctgacaatggtgacatcgatccttgcattgattctgatcgcagtattctttatcacgtctgctgattcagctacattcgtgctgggcatgcagacgtcgtacggttctttaaatccggcgaattctgtgaaactcagctggggtatcattcagtccgccatggcggctgtgctcctatattccggagggcttgccgctttgcagaacacagcgattctggcagcgctgccgttttctatcgttatcctgctgatgattgcctctctctatcaatcgctctcaaaagaaagaagagagatcaaaaaagcggagaaactcgataaaccgagaagtccaagagtgaaaaaagcatattaacaaaaaagatctttccgcgcctgcggaaagatctttttatttgcgatataaaataagggcggaaaaacagtaaagctgctcgccgtctgggtcgcacgccgccgaaaccgtatatttgatatcaatcagctgctcctccgatatcccttttaaaaatgaattgatttccgtttgtaagtctttttcatgctcttcatcaaataccgctaccttcagcattttatccgctctcctttctctatcaatctattccgtttggaacagcgttatgatagagaaatgatgattatctcgtttccggataaaaagctttccgtatatgggatttcctctgtggctcgccgccgtgctgctccactttcagcagcacggcataaacaatgcgcatatgacagtagctgataaggctgacgctgaaaaaagggacaatgcccggcaggtacgcaagcaagaaaaagagagcaacagtcagcgcaagcatagcaagcgtatattgcaaatacgccacactgagcaagagcgaaaatttcacatacagacgttttttccagtcaaaatggacaagcagcggaaacacataaaaaagcatggatacgaacaaaaagccaaatatcataatggcgaagcgcaggatgtgcagaaggaaatgacttggatagatgaaggccaaatcaatataaatgatcactccgatgagcgccagtacagcgccgagcagatttgaacgaaaaaattcacccttatattcctgccaaaacgttttgagcaccggaacgttgtcctgcccctggatccacttccgcatgacagcgaataaagccgcggtcgcgggcatgatgccaaacacgccgagaccgagtaacgtaaaaaacagccacagcaagtttgtatacgcaaatctcataatccattcgcaaaaacgcagcatccgtcccagtgagccatcatgttccatggcgccccctccttttttgcattatacattctgcatctgaaaaagctctttcatgccgatcggcttcttttcggcaaccgagcgccacattccctcaccaaccgcgatggagtaggctccagcttcagccccggctaaaatatcatagcggcgcagcgggtcttttcctaaaaaaagatcctcaagcaaaagcggatcacctccgccatgcccccttcatttttgaccacttgtatcgtctgctttgattcaaaaagcggatagtaatcgattgtctgctcaggaaaagcaaacggaattctggaaggttcgtgaaattcatttgattcaatacgcccttttgtgccgttgatcgtcagccggtagccttcatacggggccgaaaaaataatcgagtagcttaacagtgcgccgccatcatatttgactgccgccacgtacgtatcctcgatgtcaatttcctcgtcaaaaatacacgcgtcaggcctgtatgcagtatataagctggactggtctcctgcttcgagatgatcatcctttatagaagctttagaggaacggggatgccaccttgaatagtagtggcatttttctttgacccggcacgtcccgcaaaaacgcccgtcttcttccggcaaggggttccactcactgtccggcccatagtaattcaaggcgccataagcaaatacctcttccggattttgcccgagccaccaattgacgagatcaaagtgatgtgttgatttatggacagaaaggcccccggaaaactgtctcgacctgttccagcgtttaaaatagctggcgccatgatacgtatcaatataccaatttaaatcaacggaggtgaccctgcctatttttccgtccagaatcatttcttttattttccgatgaaacgggctgtagcgatagttaaacgcgacggtgacttttccttcgcttttggcctccgcttcaagcacccgattcgcatcctgcactgttgtcaccattggtttttcagtaatcacatctgtattccactgaagactttttacaatatatgtgacatgcgtatcgtccctgcctgccacaatgacgatatcaggctttgacacgcgcatcatctcgtcaaaagcatcttcgctaaactcgggcacgtgggccagctcgggaaatttcttcttgcaaacggcaaaacgtttcggatcggcatccagcaatcccgtaatctcataatgagttgaaaaccgctccaacagcggtttgataaacatactgaatgctctgctgctcaatccgcaaaagacgatgttcttcaatatcctcacctctatcgggcttcagttagttgagaaatcagctgcagcgcttcctctgttttttcagcatacacagggataaacgccgccatatcgcgattcaattgaaaagaatagccgttcagctgttttttccctttttcgatctgaacggcatagatcgttttttctcctgttttattattaacaattgtataaggagatgttttttcaggagccaatccgtttaacggctgaaaattttccggatcatcgtaagcttgaaacatgtcttcaggcacgatgaaaacatctccctcatgggcggtaatttcagtcagcagtttttcctgaaaagctggtaaaatatcgaccttcccggcattctgctcagcggcttgttttattttttcctgtacgccagcctgcatatcagaaaagagaatgacatgcattccgtccggcctgcttgagcatgatgccaaaaagagcactgagacgatcacacacaaagccgtacgtatacctgtcatcatttctctgctgtcctaaaaagagtctccagctctgtcatagccaaaataaacgcaccagccccgtgcagatcgtttgtgcttctttcgcggctgacataatagtcataaaaaccggctgacgttccgacacatatgtctttgacgagaaacgcgccgtcttctgatgtttcggttttatgctgaatcaagccttgatacgcttttagcagtgttgtttcgtaagctctgtctaaatagcctttattgattcccttcgcaaatgcgtacatgtacaggcaggatcctgagctttccagccagttatcagacctgtctcccttatcaacaatctgataccatagccccgtctctttgtcttgatagcggcagatgctttccatcatgtcctgcagcgtgtttttccacacatgacggtttggatgcttcttcggcagctcttcaatcatgtcagcaagagacatgacgtaccagccgatggaacgtgcccaaaattccggtgaacagcctgtctcttcattggcccaaggcatttttttcgcttcatcccaggcgtgataaaaaagtccggtttttgaatccttcgtatgctttctcattaatgactcctgcagcacgacctgatcaaacagctccggctcctgcttcagattggcatatttcagtgcgaacggcccccccatgtataagccgtcaagccacatttggtaaggataaccgtctttgtgccaaaaaccgccctcagacgtccggttcagtgttccatataagccgcgcagcctttttgccgctttgacataccgttcatccttcgtctgctcgtataatggaaaaagaatgagacccgcttgaatggcatccagttcatctcttttaaataatagattgccataatcatcgattaagagatctgcataagccttcgcatactcaaaataccgcttttccccagttgcttcccacagccgcaatacaccgcataagaaaacaccctgatggtagtgccagcggtttgcaggaggcagctcctcgactgtgtacgtattcataatggtttttgccaatgcctccgcgtacgtaagaggcgattttacagcgattgattgatccattgatcccatccctttcttaataaattccttcctcgccaaatttcttcgccaaacgattcgctagcatgaccaaaatcagcccgaccgccgctttaaatacgccgactgctgtactgtagctgaattggccctgtttcagccctgcagtataaacatacgtatcaaaaatttccgccacttccctgttagtcgcatttaacagcaaatacacatgctcgaagccaagctccagcgtgtctccgattttcaaaatcagcaaaacgacgataacgcttttaatggcgggcagcgtaatatgccacatttgccgcagccgtcccgctccgtccattttcgccgcttcatacagctgggggtcaaccgctgtaatggccgccagataaatgatcgtcgaccagcctgcttccctccagataacctgcagaatatacaggggccggaaccattcttcgttcagcagaaaattgattttttcaccgccaaaaaacacaatcagttcattaatcaagcctccgtctaccgttaaaagcacaaacgaaagcgatacaacaatgacccaagacataaaatgcgggatataaatcagcgtctgaacaaattttttaaagagagcaatccgcacttcgttcaaaagaagcgccagcagtatcggcaccgggaaaaatatggccaggttcaaagcaaataacacgagcgtgttttttaacaagagaaaaaatgtaggctcagtaaacagcctgataaaatgcttcagccccacccactcactgcccaaaatgccgaggaacggctgataatcctgaaacgcaatcacaattccccacatcgggacatacttaaaaagcaaaaaataaatacacccggcaaaatcatcaagtacaaatatttttgctgaatcagcttacttagtaagcgctttcttttttcttttttaaaaatgactgcatcaacagccggcgcttgcgcttctgctgttttcattttttcccagcctcctttcacgggttcttgcattcactgtagcgcagcaggcaaaagtccgtctacaatcatatgatcacatcctgttttatccctttataatcaagggttcagccggtccacctgaaaaaaagacaccaatattagaaaatgattattgacaatatctatcaatctttggattaattgtattaaggtgaagtggatgttatgaaatggggggttttatgaaaagaagccaatacaagttttactacaaactgatcacgtttttctgcctgctcagcaccattccggttattttggtcggattgttttcgtacgagcactctcagaaaacggctatttccaacgtttcggaggaaaaattcgacacactccagcagacccagcaaagcatcgaacatatattgaaaaccgtcgatcactctttaacccactatgtgagttcgccgcctctccttcgcacattgtccgagcctttgcactcagaccaatttcaaatctataaccaagtgaaccaagagctcaattatctgcaaagctttgataccgacctgtccaacatgacgttagtcagttatacgaaaaaatggtacatgaacaattccggtttgtaccgtttgaatacagatactcttcatgaagcagcctcagcatacacgaaacacaaagcgagccgttcatattggacgcttgaggaaaacaatcatttgatttcaaccaaagaaggcacagcagaaaactgccgctacaatattaatttaattaagcagcttcctttgaacagcacaaatacaaagggattggccgccgcaagcatcccgagctgttcgcttgtcaaaaatatgcccggctattcaaacgccaacaacctgtttatcatcgatgaaaaaggccgcatcatccttcataacaacatgtctgacgttggtgaaactcttcataacgacggctttgtccaaaaagtgctggcgcaaaccgccaatagcggacagtttgaaacagttattgatcggattcattataaagtcacctatcaaaaatctgactataatacatggacttatttttctctcgtttccctgcctgagctaaaaaaagaagccaaatcaatcggctggatcacttttgcagtatgccttattttgttaacgctttcattattgttctcttggctgggctcccgccatttttacaagccgatcagggtgctttacgaatcattcgcaagacatggagccatacaagagaaacaacagcctcctcaaaatgaatttgagttaattgaacagagctttaaacagctgaaggaccgaaatgacgaccttgaggaaacgatgaagcagcaggccactcatctgcagcaatattttatggtcaggcttatgcttggaaaactgacggatgaggaggttgataaccgttttgaaagtctcggtttaaagcaaaattggcggcaccttgccttgcttgtgctccaaattgacacactgaatcatacgccttatgagaaaaaagatatggatctgcttttgtttgccgtcaacagcctgattgagcgcagcatcccgacggacaaacatcttgcccccgccgtagttgacaaacagcaggcgacgattttgatcaaccaaagcgggacaaaagaagaattcatagctgagctgaatgagactgcaagaatgattcaggaaaaagcggaagctgagctgcagctgtctgtcagcatcggcatcagccagccgtttaatgtgctggcaaaagcgaaaacagcctatgcggaaggctcagaagcgttgaaataccggcttaaagcggaaaacaagtcgatcattttttacgaagaccttgaccagaaaaaaaccttcaaaacccattttccaaagcagcttcagcatgagctgttcgatgccgttaaagcaggagacaaggagaaagcggataaatgcctgcacgcgattttgcaagccattttcacccagaacaccaacccgtatcaatttcaaatcgccatcgcccgttttttgaaccatgtgattgagctgatgcatgtgctcgggatcgaattgtttgagcttgaagaaaacaaaatgctatatgaccaaatttttgagctgaaaacgttcgaggataccgaaaactggctaaagaatgagtttattgatccgatgacagacaaagtgaacgcccgcgcggatgcccagtacaaaaatatttccgacaacatcattcatatcatccatcatgagtttgaatccgaattgacactggacgaaatcgcgcgcaggctgcattacaacccaaattatttaagcagcattttcaaaaaagaaatgggtatttcattcagcgagtatgtctcaagctaccgacaccatatggcgaaaagctggcttgccgaaaccgacatggcggtcaaggacattgccgaaaagctgaaatataaaaactcgcaaaatttcatcagatcatttaaaaagctggaagggattacaccgggaaactaccgccagcaaaaaagaagcatgtaaaaaacccaaaaccgcttgcgcgttttgggtttttccaatgttattttgcttgtttaaacgcttcttcgtattcctgaataatttgttttcctccgcttgactcccatttttccacttctttatcgaactggctttctgtgatgtctccaatcatatatttgtaggtcgcgtcatcaatgattttcttcagttcatcaccccgttccgactccgatgcggaatacaggctttcagccgggtttgagacgataatcttttcattgtcctcggtcagctcctcgtacgccgtccgaagcggatctccagtgttttttaagtaggctttatcaatggcaattaaagcggacagcggctgaatatcagtctgccagtcttttacctggctttctttgcgtgtaaacgttttgtcctcacctttgttgtaatgaacgccgtcaatgccataagtcatcaggctatagacatcttcttcggcaattcggtcaaaaaacgccaagatccgtttaagctcagcttccgttttcacactcgttttcgggaaagcaaacacgccgttatggcctcctgatgcccatacccgctctttcccatctgggccttttatgcggttgatgatctcgagcttcatcgatttatcagaggcatggtcgcgcagattgaccgcatctaccatattgccaatataaattccggcttttccttgagaaaacagctcctgctgctgggttttgcttgtgacgggaaaatccttattcatatacccgttatcacgcagctttttcatatagttcatcgtgtctttgtattcctgtgtcatgaaatcaggcgtgaatttgccgcccgattccttccaatctgtcggcatgccttcatacgagccaatcgttttaaacgcgccgtaaatcaagtcattacggtctgtcagcccgatcgtatcatctttcccatccttgtccgggtcgtcctccgtaaatgctttggccacttcataaagctcatccaacgttttcggggttttcaaatttaaattgtccagccagtccttccgaatgacgatcccctgtctggaaagcgggcgctctctgtatatcccgtaaagcttgccgtcaattgtcacatttttattaatgagtttgttcattttgtttaagttgggataatccttgatataatcaccgatttcccaaaacattcctgaccggaaggcattcatgactgacgaatttttaatatcctggatggtcacgatttgcggaagattcccggctgcaagcgctgcattcagcctgtcttctttcaccgcgtctggaacccaggtgatgtcgagttctgtatttgtcagcttttcaatttctttaatcgccctgtctttcggcggctgctggtgatacaaaatcgccatccaagacagctttacctttgaatccgggccagctttgccttcagccgaagactgatcagcccctttacagcccgccagcactccgccgagtgccagtacaagcacaatcaaaagcaccctccatttgtttcccatcgtacccctccgtttcatatttctttatcctttgacagatcccagcaaagctccttttgcaaaatgcttttgtataaacggatagacaagcagaaccgggatggtcgccaccactatgaccgccattttaatggtttgctcaggcggcgggctgcccgaccccatttcagacatatccccctgcataccgcttgatacaatgacgatttggcgcagaagcacctgaatcggccattttgctgaatcatttaagtacaagatcgctgtcatatacgtgttccaatacgtgaccgcataaaatagtgaaatcgttgcgatcgcaggaagagacagcggcagcacaattttaaagaatatgcccagatcattgcacccgtcaattttcgcggactcttccaagcttgacgggatattttgaaagaagtttttcagaatgatcaggttaaaggcattaatggctgtcggcaaaataagcgcccagtaagaatcgagcaatccaagcgatttgaccacaaggaaagtcggaatcatgccgccgctaaacagcatcgtaaatacgacgagaaacatgagcggctgccggccgattaaatcacggcgggataacccgtaagccatcagtgacgaaagaaacatgctgaccgcagtgcctatcactgtcacaaacacagaaacaagcaagctcttataaataatatctgttgaaaaaatgtagcgataagcatctagcgaaaaagtggtcggtattaaaataaatgttttcgacacgacttcttctactgtggcgaaggatgctgcgatgacatgaatgaacggaagtacgcatattaaagcgaacatcagcaagaaaccataaatcaacatatcaaacagacggtttttcagtgaatgtgcgatagcttccacctctctttgtaagcgttatcatatttttgaaaaccgagctcagcatgtgacgatatcgtgtctaaaatgtagcaaatctgtgattgccatgtctataatcatttgaacagtgtccccggccgggcgggggctgccgcgaattgagaccgataacaaaagaaaaagagcataatcttagaaaatgattatgctccgttctcctcctcgttcagaagttcagccgtattgatttgtggcgaaaacccaagttcattcacggcagattcaatggaccatggccggcccggattatcagagacggcgtaataagtgccgtaccggatattggtctcaatagcggctttgaaaatcgacagcagatcggggtgagaaagcagtgtctttttcgtccgttctttttcatgcagcgtatccatttcatctgtgacgactgttccgattcgcaggttgattactgatagcttattttccaaataaaacaaatggccgatctgttcagaggtcagctttaatacaccgtacaagttttttgacagcggataatcgcttgttgtgatttcccgtcctaagagcgagcgcccgtctttttcgtagacatctgtgacatgattactgctggcgaacacgagcttttgaatgccgagctccgctgccgcacggcacagataatagcttgccctatagaaaacatccgtcattttttcaaactcagcgatgtccataatatcgtatttgattttaacagcgagtaaattcaagatgacatccgtatcttttggaatcttcttcaacagctcctcatagtttgccgcgtcagcctgaatggaagaggctttgccatcgaaatgatctttatcaagcactgtcacttcatagtctgaaataagcccttcagcaagcagtctcccaatcacaccatttccgccggcgatcagcacttttttcactatgttcactccccttttttatagattgcccattttcggcggggctgacacttttttggcactcacattcttaggcttattcaaaagtcaccggcagctcctcaagcgcccgaaatccaaaaagcggccgataccgccattcaaaatccgcgagcttaaggctgggcattcgctgcagaagggtgttaatcgcaatttgcgcttctaatcgtgccagcgaggaccctaagcaaacatgatggccatgcccgaatgaaagatgcggattaggacttctcgtaatatcgaagacatcggggttcgtgaatatgctagggtctcgattagccgctcctaacaaaagatagacttgctctccttgacggatcgtcaccccgcagatgtcaatatcctctgacgcaactctggctgtcatttgcgtggggctttcatagcgtaaacattcctcgactgcggtatcaataagatctggattttctctcagtttcaaaagctgttctggatgctgcagcagacaaaggactgaattgctgatgagattaaccgttgtctcatgtccggcgatcgccagcaatatgcacgtagatgccgcttcctcttccgtcagcttatccttttctttccccttcaagagcatgctgatcatatcctgttgagggtggcgttttcgctcttgaatcagctctctgaaatatgccatagcctgcacagccatatgattgccctctgttaatgcctttcttgaccgggtaaaatcaatcgtttgaatgagactcccagcccactcctttaattgctccctatcttcctccggtacacctataatgttagctatgacaaagcttgctaaaggaaaagcaaagtccgaaatgacctccatcttttttttaccttgcacttgatcaagcaaatgatggacagtttcaatgatatacggctgataactctctgtcgctctcggcgtaaacgctccgctggcaagcgtccgcaatcgtctatgatcaggctggttctgaaacagcatcatttgattttgcacatgtgaaaggtcctgatatttggttgagctctcaggcagcggggtgcggactttgaatctcgcatctttcaaaatagcagccgtttcttcatatcctgtgacataccagcccggatattttaagaaactccctttatagataggatgaacagctcgcaatgtgtcgtaaaaagaatatgggtttttcaaaaactcagaagatgcagttgatgatgcaattgtcacgtgattttctcctttctgttcaaaaataaaagcaatcgacatcataccgattgcttttattgattctttcagcttttcgcacttaaactggccttcatttcttcgactgattcaacttcaaagcctaaatcactcagcattttatgatcctccgtctcctcttgcccggcagttgttaagtaatctccgacaaaaatggagtttgcggcgtaaagccctaatggctgcaacgagcggagattgacctctcttccccggaaatgcgaatttcttttgatggattgataaaacggaacagcgccagcacttttaaacaatacagcgggtttaattcgttgacgccttctaacggcgtgccatcaattgcatgcaaaaaattcacaggaatggaatccgcgtcaagagccttcaagcttttggcgatgtcaatgacatcctgtttcgtctccttcatcccgataatggcgcctgaacacggagacagccccgattcttttgcgatttcaaccgtactgactctgtcatcgtatgtatgtgaggtcgtgatgtttgaatggtttctctgtgacgtattcaaattatgattatagcggtctactccggcatctttgagccgcttcgcctgctctggcttcaacagtccaagacatgcacaaatcttcagtccatacgtctctttaatttcctgaaccgcatctacgacctgatccacttctctgttagacggccctctgccgcttgccacgatacaatatgtgccgatattcagatcgtgcgcccgcttcgcgccttcaagcagcgtttccttattcaccatccggtaagactcaatcggcgctttcgaaatcgcagactgtgaacaatagccgcagttttccgggcagagcccggatttcgcattcataatcatattgagctttactttttttccataaaagtgttttctgatgtgaaaagctccatgcattaatagcaaaatatcttcatcaggacaatttaatattgaaagcgcctcttcgtcagtcacttctgctccagccagcacccggtctgcgagttccatccattgattcattctcatacccccacttgattcatcagtaatgatagattgatatggtcttttaccatatgtagaaccgtttctttcgtaacgttggcaagctttggcgtaacccctaaaatcggaacaccgcataagcgctcaatcatctcaggattggttttttcatcttcatcaggagagtcactgattccattgatgataattccggcaattggaagccccatgctttctgcatatttgacagttaaaaaggtatgattaatggttccaaggtgaggacgtgccacaataatcatgggaagctgcaacgcttttatgacatgactgaccaaatagtcctctcccaatggcacagaaataccgcccgcaccttctacgatgaagcattcatgtttttctctaatccgtccccaatggcttaaaacctcttccatggtgacagtctttccctcaagtttccctgcaacgtatggtgcaagcggcgctttgaaggcaaaaggcgtaatgtcttcatgagaaagactggtctgcgacatgtctttcagcagacttgtatcactatctggatgatgacgcgatatcccgcttaaaaatggtttatacacaccgacatctctattatgttctttcaataaggcagcaagaccgctggatataaccgttttccccacttctgtatcagttcccgtcacaaaaaaacccctcaaatgatatgcagctcctttccgattgaatgaaatgttttcagcaaatcatcaatatcacccatactgtggtcagacgtgattgtaattcgaatacggctttcacccggcgcaacggtcggaggccgaatggcaggagcataaattcccttgccctgcagtttttcagcaaatatgaccgttttatgggcatcgccaatgactacaggaataatcggtgtgtgatctcctttcaccacataccccatattcatcagactggttctgatcgtactgatataagaaaatacaagctgccgtttttccctgctggcttcaatgatgttgaaagcctcatgagcagccgcacagctagctggcggaatagcggtttgaaagataaatgttctggcatggttcagcaaaaagtcgatgaagaccgctgatcctgccgcaaaacctccttccgcgccaacagctttgcttaaggtgccgatcacaatgtcaggataaacaccaaagtattcactcgttcctcgtcccgaatcgcccaaaactcctgttgcgtgggcatcatcaacgaccacgaaggcatgatagcgtttcgcaagtgagatgatctgatcaagaggggcgattgtgccatccatgctgaataccccgtctgttacgataaaacggcgctgataacgctgtgtttcattcagcttgttttcaagatcattcatatcaatatgccgataaacaactgtatcagccttagaaagtcggcagccgtcgataatacttgcatgattgagctggtcacttaaaatgacatcttccttttctggcaaggatgaaaggacaccgacattggccaagtaaccgctcgaaaacagcagggccgcttctgtccgtttaaagctggcaatcttcttttctagctcttcatgccagaccgaattgcctgtcgttaaacgtgaaccgctgcttcctgtcccaaattgctgcaatgctgtttgggctgcatcgatcaagcgtctatcacttgcgagccctaaataattgtttgaggaccagacggtttgattcttgccatcaatgttccgctctggaaccggtgccccattcattgaccgcagattacggtgtgcaccggcttcctttactatgtctaaccgctcgtttaaccaggaatcaatcttcaaggctcgtaacctcgtggatcgcttgtttcataatggcaaccatttccgtgagctcttcagctgtgctggcgagaggaggcagaaatgcaatcacgtccccaagcggtcttgtcagcattcctaactctctcatttttaaggaaactttgtatccaatccgccgatcagccgggtaaggttctttggtttcctttgaccggacaagctctgcaccgcacataaagccaagctgccgaatatccccaacatgaggaagagcgtgcagatcttgaagaagaaaatggagctttttacttttttccgctacttgttccacaatgttttcagattcaaataatgccagattttcaagcgcaaccgcacagccaagctgattgcctgtataggaatggccatggaaaaaggtttttaggttttcataatcatcatagaatgccttatagatgtcttcagtggcaaacgtaacggcaattggcaaatagcctcctgtaatgcctttaccggcagccatcagatcaggctggacattctcgtgctcgcacgcaaacatttttcctgtacggccaaagcctgtagcgacttcatcaacgatcattaagacatcgtatgttgtacatagctcgcgcacgcctgccaaatatccttccggcatcacgatcataccggatgccccttgtaccattgattcaatggaaagcgcggcaatttcctcatgatgttcctcaagcagctgtgcaagctctcgcaggcactgatcacggcattcatcaggatcaccgctttcagagcgatacacataaggaatcggggccttgtaactctcgaacatcaacgggccgtatacgtggtgaaaaagctcaattgaaccgacactgacggcgccaatcgtatcaccgtgatacccgtttttcattgcgatgaatttttgtttctcgggcttcccgatgttcttccaatactgaaacgccatttttagggctatttccatcgcttctgcaccgctgtctgaataaaagacccgcgtgagcttttttgggctgatgtcgattaatgtctcggcaagctgggttgctggaacgttggtcatgcccaataacgtggagtgcgcaatttttccgagctgtttttttatggcgttatctagttcttttttgcggtgtccgtggacattaagccaaactgatgaaaaaccgtcatagtattccttgccatttatgtctttgactttgattccagtcccgctttcgatgattaaggggttttcatcataatctttcatttgggtaaatggcagccagaggtgctttttacttttttctatcaaatcatgagtcatggtcttcctcccactctattaaaataggctgcttctccagatcatgtatgtacgtgtttacatcattggatccatcaataaaaaagactcggcagccctcttcagtcccgtattctttcattgctgtaatacgctgatagcccattttcttacccgcaacatagcctgttatgtaatccggatcgtccgaccagcataattctgcaatggctgccgggtgccggcttacctttgaagcgagcgcaagggcctcttttattcttgaatgagctggcacgtgactgtgaagcgcccatttttcaaaattagcgtccggccaatccattctggagacccgcacccctttttcttttgtttgatccattcgcttgcctgtatgaatatcaaacaacaccgcacccctgacatctgaccattctgggatttgttcatacgctttttcaatcacgtctcgtgaaacgccttctttttccaataacaatcgggcaagcttttgtccttctcccgggcagctcacttcattcgtatacacaggcaatggctgaatggtttttatcgattcatgtacctcttcaaattgaatttgcataaaatcaggttttcctcttgaatgggataaccctttttctaataaagcattgactgtatgcttcatctcatggaaaggaataagccgttctccgccggatatatgctttccgccgtcttcatgagatccattcatagaagccctcattctgacactataaaaagtttcttcttgcatcatttctcgccctttcactgataactgaagaacgtgtagcgcttctcacctcaattgttaaccaattatatttaaaggttaacaattagaatatattattctctcctgtttctgtcaatagaagaaaggatcgatttatggcagttggttaaaaggaaacaaaaagaccgttttcacacaaaacggtctttttcgatttctttttacagtcacagccacttttgcaaaaaccggacagcttcatgcctcataactgctgtttcgaaatgtcccgaagcagaacggaccactcggtagcaatcagcagctccctgtccagcatagacagctgtcaattctttttcgattttgtccacgccctcagccggcgttaaccgatcgtgtacaccaacaagactaaggtgcgggcgcggcgcgatcaggctttggatctccgatgcggaaaaatgctttgcaagcgatgggacgtaataataaaagccgtgcctgtcaagattctgtgttttgatcagcacgtgatgatccacctggctgcacaaatccacacacaccttaatccggtcatcgagcgccgctgtccaccacgccatcaaacctcccatagacatgccgatggttccgatcctgtcaggctgaacatcagagcgtgactgcatatagtctaacgcacttaaactgtcataaatcatcatcccccacatcacttttccggtgagaagcatttctttaaatatctcgctttccgcttttccccgccgatctccaaatccccaatgatcaatcgcaagaacgccgtatccgagtgaagtaagctcatcagaaaaagaaggcgttttcaaataatccgctccctcaatcagctcactttttcccctatcatactggcccccatgcgaatgctgaaacaatacggctgggcacggtccttctgttttcttcggcttcacaaaataagcgggcaccttttcatgtccatttaaatcgagcaggagcgtttcaacgatattttcttctctttcttcaatacgtaatgtctcaacactgattggcctccgatcaggcaaatcaccaagcaatcgaaacagttgctttcttctttcggctctcatcccatcacccttccttattcgcttacttcacatttacgagacagattctgggttcccctttatttttccaacataaatcacatcatttactaaatatttagtaaatataacgaaatattccgaaaacaattattgtaactgtttacttttatatgatagtatcaatttatcaaaaacagatgagttaatattttactaaatagataagagggatacccatggttcgtattaaagatatcgccttgaaagctaatgtttccagcgcaactgtgtccagaattttaaatgaagatgagtcgctttctgttgcgggcgaaacgagacaaagagtcatcaacatcgctgaagagcttggttatcaaaccgttgccaaacgccgaaaatcccgcgggcaaaaacagcgggcccagccgctgatcggtgtgctgagctgtctgtcccctgatcaggaaaggcaggacccttacttttcttccattcggaaaggcattgaaaaggaatgctttgaacaggaaattttcattacaaattcgattcatctcggctcatttcaggaacatatctttcgggaattggatggtgtcattgtcattggccgtgttcatgatgaagcggttaagcatatcagcggaaggctggagcatgccgtatttatcaatcattcaccagatccgcaagcatacgattcgattggaatcgattttgaatcggcttcacgccaggcgattgatcaccttttcgacttaggctacaaacgtttaggctacattggcggacaagaaaaagagcatacgctgaaggacggccaaagcattcgcagaacgattgaagacaaacgcctgaccgcttttttggagtcagccaccccccagcctgagcatgtgctgatcggagaatacagcatgcgtgagggctatcgcctgatgaagaaagcaatcgatcaaggccatctgccggaagcattctttattgccagcgattctatggcgatcggcgcattaaaagcgctgcaggaagccggactgcaagtgccgcgggatactgcaatcgtcagctttaacggcattgaggaagctgaatttgccagcacgcctttaacaacggtgaaggtatacacagaagaaatgggccggacaggcgtaaaactgctgcttgaccgtctcaatggccgaacgcttcctcaccatgtcaccctgcctacaacattaattgtaagacaaagctgcggatgtacagcaaaggaggtgacataagcaaagattcatcacgatgataaggaggaaaagatgaaacacacttttgttttatttctctctcttattctgcttgttctgcccgggtgttcagcagagaaaagctcagcagataccgcaaaaaagacgttaaccatttattctacaatgtcaaccgacagtgaaagagatacgttcagaaaactggcagcagcattcgaaaaggaacacagtgacattcatgtcagccttcatttcccaggcaatgactatgaaaatatgatgcgtgtcagaatggcggccaatgatttgcctgatctattcgatacgcatggctgggggaaaatcaggtacggagaatatacagccgatctccgggatatggaatggactcaagatcttgatcctaatttaaacagcatcctcaaaaataaaagcggaaaggtgtatgcctatccaatcaatcaggcaaaagacggtctggcgtataatcgcaatattttagaccgttacggcattgctccgccggaaaccatggatgactttatcaaagcactgagaacgattaaagaaaagagcaagggaagcattgttcccttctggtttgccggctatgacaaaagctcattcgctcaatattacgaccaattcgctacacctcttctcatcacagaccctgcccataatgaaaaaaaacagctcaccaatggcactttcaaatggaataaatttacttacttatcgaaaatcctcaaacaaatgcagaaagaaaaattgattaacatcgacgccgtcacggcaaaaaaatcacagctcattgaattaatggcccaaaacaaaatcgcctttacaatgcaaggcggcacactcggccaagacgttgcccagatcaactctaacgtcgaggtcggcattatcccgacacctgccatacatcccggtgatgacccgatatggatcggcggtgaacgctacacgcttgcagcatggaaagattcgcctcaattaaaagaggcaaaagattttatcgcatttatggcccttccggccaatgccaaacaaatggctgaagccacatcgcttccttcagggctgaccaatgtgaaagctgatattttctacgcaaacgattatgagcattatcaagatgtcaaagtcgagccttacttcgaccggttatacttgccaaacggaatgtgggatgtcctgggcacggttgggcaggagctcgcggctgacattttggcgcctcaagacatttcgcagaagctgggaagagaatataaacgactccgggagcaatcggaaacacagggagctgaaaacaatgagtgagatcgcaagggacgttcatgtgaaacaggttaagccaaaaaagcagtcctcactttggtggatgtacattcctgctttgctctccgttctggtctttatgatttatccgtttgtgaaaggcacattgattacctttacaaactggaacggcttttcacaagtctaccaatgggttggattcgcgcaatatgaaaggctgttttctgatcctgacacttggcatatcttaaaaaacacgctgctttacgggcttggcagcactttttttcaaaatgtggtcgggcttctatacgctctgctcttaaatcaaagcattaaaacgaaagcggtaacaagaacaattgtgtatttgccggtgatgatcagcccgctcattatgggctacatttggtactttttcttctcctatgacggaggcgcgctcaacgatttgctcggggtcttcggcatcagccctattaatgcgctcgccagtccatcactcaatccatggatcattgtcatgattaacacctatcaatatgtcgggatcgctatggttgtctacttagccggtctgcaaagcattccgaaagactactatgaagcggcgcaaatggatggcgcgaaacaaggccagcagttttttaccatcacgctgccgctgttaatgccctccattaccattaatatggtcatcaacattatcggaggcttaaagctgtttgacgtcatcattgcactcaccgcaggcggccccggaaatgcgtcacaatccatgtccacgtttatgtatgatttgtatttcaaacggcaggatgccggctatgccgcaacgcaaggcatatttatggcatttgtcattttgatcatcagcttttgcgcgcttgcgtactttaaaagaaaggagacggaaatgtcatgagagccgcccgtacaaaaagcatgcggatcattacgcttcttgcagccattgtggcctgtgcgcattttattcctttttatatcctgctgaccacttcattgaaagcaaaaggagactacagttcgaaatggatatttccagccgacatctcctttcataatttttcagaggcgtgggagcgcgcttcgctaggtaactcttttataaacaccatgatcatcacaggtttttctgccttgttattaattatattcggctcacttgccgcctacccgcttgcccggcgggaaacgaaactgaataaagctgtttttgccttgttgatttccattatgatcatccctccgttaacgtccatggttcctttgtatcgaatggtcgtggacgccggaatggtcaatacacacgcaatcgccattttcatcaatacagcggcttacatgcctttaaccgtattcttatattcaggctttatccgatcgaccattccaaaagagcttgaagaagccgcaagaattgacggcgcaggcatgctgaaaatcttttttacgattgtgtttcctctgctgaagccgatcactgcgaccatctgtatcatttcttgtgtctttatttggaacgactatcaatttgccattttctttttacaagatcaaaaggttcagacattaacagtagccatggcaggttttttcggagaaaacgcaaacaaccttcatttagttgccgcagcggcacttatggcaatgctgccaatggttgttctgtttttggcgctgcaaaaatactttattgccggcctgtcttccggagcggtaaagggttaacattaaaggaggaagcaatatgaaaaagattacatttatcggtgcagggagcacgattttcgccaaaaatgttttgggagactgcctgttaacagaggcactgaatggatttgagttcgcgctttatgacattgatcccaaacgcctgcaggaatcccagctcatgctcgaaaatctaagagaccgttataacccaagtgtggccatcaacagctatgatgacagaaaactcgccttgcaaaacgcaggctatgtcatcaatgcgattcaggttggaggatacaaaccgagcacagtcatcgatttcgagattcctaaacggtatgggctgcgccagacgatcgccgatacagtcggcattggcgggatattcagatctctcagaacaatcccggtcttatttgatatcgcaaaagatatggaggaaatgtgccctgacgcatggttcttaaactatacaaatccaatggccactcttacaggcgccatgctccgctataccaatatcaaaacaatcgggctctgccacagtgttcaagtgtgcacgaaggatttatttaaagctctcggaatggagcatgacggaattgaggaacgcattgcgggcattaatcatatggcttggcttttggaagtcaaaaaagacggcacagatttatatccagaaatcaaaaggagagcgaaagaaaaacaaaaaacaaagcatcatgatatggtgcggtttgaattaatggataagttcggctattatgtcacagaatcgtccgaacataacgcagagtatcacccgtactttattaaacggaattaccctgaactgatcagcgagctgcaaatcccgctcgacgaatatccgagaaggtgcgtcaagcaaattgaaaattgggagaaaatgcgggatgatatcgtcaataataaacaccttacgcacgaacgctcaaaggaatatggttcaagaattatagaagcaatggaaacaaacgaatcattcaccttcggaggaaacgtcttgaatacagggctgatcaccaaccttccttcaaaagcggttgtggaagtgacatgcgtcgccgacagaaaaaaaattacaccgtgcttcgccggagaactgcctgagcagcttgccgccttaaaccggacgaatattaatacacagctgatgacaatcgaagcggctgtcacacggaaaaaagaagcggtttaccaagctgcaatgcttgatccgcatacaagcgcggagctttccatgaaggacatcatctccatgtgcgacgatttatttgcagcacacggcgattggcttccggaatacaaataaaaactaggggaccgctctcccctagttttttggttttgtttcgccttcccaggccatcatgccgccttcaacattgactgttttaaagccttgctcatccaggtacttgcagacgttcatgctgcgcattcctgagcggcagataaatacgtactctttgtctttatcaagggtttccattttttcaggaatatcccccatgcgaatatgaacggcttgcgggatcatgccttccgctacctcttcatcttctctgacatcaattaaatataattcttcgtccgcctcaattttttctttcaaagcggctgtgctgatttcttttatttccaaagaaaacactcctattcacagtgatcatgttcagtatatcaaagtcagccgaacgattgctattctgagactgatgaaaaaaatccccttttggcaaaggggattttttctaggcttagtttgccacaatattgacaagcttcccaggcaccgcgatgattttccgaatcgttttgccttcaagctgctctttgaccttttcatctgcttgagcaagctgttccagctgttctttcgttgcatcggcaggaacctgtaatttcgcttttacttttccgttcagctgaacaacgatttcaacttcatcatccacaagttttgtttcatcatatacaggccaagcttcgtaggcaattgtgccggaatggccaagcttctcccatagctcttccgctaagtgtggcgcgacaggagaaagaagcttcacgaagccttccatatattctttcggcagttctgttgctttataagcttcattaataaagaccatcagctgggaaatacccgtgttgaaacgaaggccttcataatggtctgtgactttcatgaccgtttcatgatagacgcgctccaatgtttcacccgcgccttcaacgatttttccattaagctcaccgctgtcttcaataaataggcgccatacacggtcaaggaaacggcgcgcaccgtctaatcctgattcagaccaggcgattgaagcatcaagaggtcccatgaacatttcgtacaatctcagcgtatcagcgccgtgagaggacacgatttcgtcagggttgacaacgttccctttagatttactcattttttcgttattttcgccgagaatcattccttggttgtacagcttttggaacggttctttcgtcggcactacgccgatatcataaaggaacttatgccagaagcgggcatacagaaggtgaagcacggcatgctctgcaccgccgatatacatatcgaccggaagccatttttccaatttttctggtgatgccagctgatccggattgtgcggatcaatatagcgcaagaaataccagcagcttcccgcccattgcggcattgtattcgtttctcttcttccttttttccctgtctcagggtctgtgacttccacccactctttaatgttcgcaagcggtgattcgcccgttccgctcggtttgatttcatccgttttcggcaaaatcagcggcagctcctcttcagggacagctgttgacgttccgtcttcccaatgaatgaccggaatcggctcgccccaataacgctggcggctgaagagccagtcacgaagacggtacgtcactttcttctcaccgtttttcgtttcttccagccaagcgatcactttctcaatcgcttcctgtttgtgaagaccgttcaggaaatcagagttcacgtgctcgccgtcgccagtataagctgcttcctcgacgttcccgccttttacgacttccttcaccggaaggccgaatgttttggcgaattcaaaatcacgctcatcgtggcctggaactgccatgacagcacctgttccgtatgatgcaagaacataatccgcaatccaaatcggcagtttttctccgttcacaggattgatcgcatacgctcctgtgaatacgcctgtctttgttttcgcaagatctgtgcgttcaaggtcactctttgattgaatttctttgatataagcttcaacagcttctttttgctctgccgttgtgatgttttccaccaatgcgtgttccggggcaaggacagtgtatgtagcgccaaacagcgtatctggtcttgttgtaaacaccgtaaaggaatcatcatgtccatctatagcaaaatgaacgtgagcgccttccgaacggccgatccagttgcgctgcatatctttaatgctttccggccaatcaagctcttccaagtcctcaaggagcctgtccgcataagcggtgattttcagcatccactgcttcattgggcgtctctctaccggatggccgccccgttcgctcttgccgtcaatgacttcttcgttggcaagaacagtaccgagcgcagggcaccagtttacaggcacttcgtcaacgtaagcaaggcctttttcgtatagctttaagaaaatccattgcgtccatttatagtattcagggtcagtcgtattgatttcgcgatcccagtcatatgagaagccaagcgcttgaatttggcggcggaagttatcaatattctgcttcgtaaacacagcggggtcgttccctgtgtcaagcgcgtattgttcagctggcaggccgaatgcgtcccagcccattggatgaaggacatcatagccctgcattcgcttcatgcgggacagaatatccgtagctgtgtatccttcaggatggccgacgtgcaacccagctccagacgggtaaggaaacatgtccagcgcgtagaatttttgtttttcattattatcaagagtggcaaatgttttgttttcaagccaatatgtctgccatttcttttctatctctttgtgctgaaaactcaaagtaaaaacctccttctgattgaatacggcgtgtatggttcaagtattgacgggaaggagaggattattcagaatattcccaaactaaaaaaaactccctcatcccaaaaagggacgagagactttcgttttcccgcggtaccaccctcgttagcgcggcatacgccgcactcacttgatacttttaacgcagttatgcgtcagcggcttttcaccgctgcaactctgaggtgagttcggaaacaaacttgattgactttcaccagccgtcaactctctgcaacaatatctgtttcttactgctcctcttcattgttcttatcgcaaccgtaatctaactgtattttatagaattctgttcataagtgcaagcaggtttgtatacaatgggaatgtaccctgaacgggcggagattgaggacaattattcgggtggagttttggtttgacgtttggactcggccggttcgccgccgctgttcagttctctcacaaagtcaaaacttctgagaacagcttcaccgccgtagcctgagataatggataagatgacaagttgaattcctgaatcggggtcagcggataatacaagtaaaatggaagccgtcatgccgataaaccaatcttccaaaaatccaaggtagataaaccgcttcgtcattctgggcttctccagcctgcctctctttttcacatgaccgagaatccccatgattcctccaattacacaagcaatgagtacctgatgcagcatcttcatcatcaccttcctaaagcccttatttcgtaaagcgacttcaggccatccagcccccttaaacgattccgatgattttcgatatctacataccggcaaatctgtaaaaagcttgtttcttccattatatgtgaacacatgatcggtaagcttgatgcattggattcatttttcacccagtgacattgacctagtcacctatttagcatgtagaaaacctttccgttcatatgttcaaattctgttcttatttttagtgtatacgaggacaagccctaatgacaaacaacaaactgcacttgcttgaatcagaacatgtgttgtgctacggttactgtagaattcatttttaaaaaggggaatatcaggctttcgcatagcaagctgacggcctaagggggatttatatggctagttttcaatcatttgggataccaggacagctggaagtcatcaaaaaagcacttgatcacgtgcgagtcggtgtggtaattacagatcccgcacttgaagataatcctattgtctacgtaaatcaaggctttgttcaaatgaccggctacgagaccgaggaaattttaggaaagaactgccgcttcttacaggggaaacacacagatcctgcagaagtggacaacatcagaaccgctttacaaaataaagaaccggtcaccgttcagatccaaaactacaaaaaagacggaacgatgttctggaatgaattaaatattgatccaatggaaatagaggataaaacgtattttgtcggaattcagaatgatatcaccaagcaaaaagaatatgaaaagcttctcgaggattccctcacggaaattactgcactttcaactcctattgtcccgattcgcaatggcatttcggctcttccgctagtcggaaacctgacagaggagcgatttaattccatcgtttgcacattgacgaatatcttatcaacatccaaagatgattatttgatcattgatttatccggattggcccaagtgaacgaacaaacggccgaccaaattttcaagctgagccatttgctgaaattgaccggaactgagttaatcattaccggcattaaacctgaattggctatgaaaatgaataaactggatgccaatttttcgtcgctgaaaacatattcaaatgtaaaggatgccgttaaagtgcttccgattatgtaaaaagatcccgctcatccggcgggatcttttattatgaagagattgatgcctgcttatttgtttctttagctgattttagccgtttgtcatatagaagcgttgtggcaatactgatcagcagcaataccaacagagataaaacaagagccttaatgccgtaatgatcgacaagcactcctccgaacaggggaccaatcattctgccgcctgtcgccgcactgttgacaaagccttgataaaagccttctttccctttaggggcaagctgattggcaatagtcggcacagcaggccaaacaagcatttctccgatagtcaggatcaccatcgcagcgagaaacatcggaaattgctttgcagtcagcagcatgctgaaagacacaataaaaatgataaagccgatgaccatttgcgcttttagcgactcggcccattttttcaccacaaaactgacgagcggctggccgagcacaatgagaattccgttaaccgtccacagcacgctgtataaggaaagagatattccaatgctttgtgtgtacgaagcaattgtggttgaccactgagaataagccagccatccgagtacatagcctccgcttaaaatgatcagtgcggcaaattttgctttgctgttcacagcatcataatcaagcacagacgtttgggacgcatctcccgtctgaatatttcgaaatccgaaatatacaataaagaaaaagaccagatacagcgcggcatttgccaaaaatacatatgaaaacgagaaagatgccacgataccgccaagcgctgaaccgacggccacgcccgcgttttgcgcgacatatatcgcattaaatgccttccttcccccttcaggccataccgatcccgccattgcgtagctggccggaaaaacaacaccggagccaaagcccacaatcgtcagcagcacaatataggctggccaatcatgaaaaaagacaagacccatcaggcttgctaacgtaatggctatcccaagcataatcgatttaaaaccgccgattttatcaaacaaaaaacctccgcataaattaccagccacactggcgccggaattcagcatcaggacaagtccggctactgttaacgactttcctaaatgattatggatataaatcgtattcagcggccataaaaaagaagcacccgtcacattgataaacattccaatgactaaaattttaagagcacgcggcatactcatccccctttcttacctaaaaaagctcatgaaaaaaacgaaacctaaaacggctccgtacgaatccagttatcatagcacattcattctatctgtctctctcacatttttcaactgatgagcgtgaaaaaatctaacaaatattgtttgaaaaatgtaaaataaatagaaaaaggggtcatattatggaaatggtattagcattcttaggttttctggcatgtctcattgcactgggctatggattatatcaccttgtcagatatgtactgaaaaaggaaaaacgtttctccaagagacttttttggccgcttttcattggaggccttgtgctgctctttaccggggcagcattggcagaacctgacacttccgcagcaaatgccgagaaaaaatattcagcgctaaacgccgaatataaaaacctcacaaaagagcatgaagaacttgagaaagaatataaatctgtcagctccgaagcaaagaaattaaaagacaacaaagaagatcaagacaagcttgagaagcttaaaaacgaaaatagcgatctaaaaaagactcagaaatcattaaaagctgagattaaagagcttcaagaaaatcaaaagcagctcaaagaagatgcaaaaacggcaaaggctgaaaacgaaacacttcgacaagataaaacaaagcttgaaaatcaattaaaagagacggaaagccaaaccgccagttctcatgaagacactggaagttctttaaacaatacgagtaaaagtgatgaaaccaaaacagctgacaaagcagaaggctgtaatatcaaaggaagcaaaaacggcatctaccacacgccaggcagtacatactacgaccggacaaccgatccggctgaaatgttttgctcagttgaagaagctgaagccgccggttatcgggcgccaaaacgataaacaaaaagctccagaatgtctggagctttttctgtttcacaacgacgatttaatgaccttcttataataaagaactgacagaaaaccaaaaatggagtagagcgcagtatataacaccatcaccataatcataggcgcccatacctctgatccgaataagaaccagccggattggacggcaaagtaactgtggaagaggccgacaacgagcggaatgccgaagttgtacatttgtttgatgcgtatcccctttatcaggtcgccctgcgtaaaaccgagttttcttaaaattgtatagctcggtttttcatcttcactttctcccatttgtttgaaataaaggatacaacctgatgtaatcaggaacgttaaccctaagaagccgacgatgaacatcaccataccaaacagtgatttttgcgcagcgcttgtatccagtcttgataaatgctcgtttttcttgttcacctgttgaaaaagctcatttgctttttccatttgatcttcatgtttcacattgacgccgataaatgtagattgcgccagctgaatgcgggggtctttatccttgtccagctgtttaaacaggctgtcatccacaatgacagcgggcatgcccccgcttgtaaacgtgtaggatacaagaaactcttctcttaatcctttatattttaatggctgcgcctcatgcttgctttttactttaataacaccagagtccttgaaaaccattattttttgcagcaagtcggtgtatcctgagaaaacggcttctccagccgccacatcgactccttttacatctttgtcgctaacaacagcaagctgcatattgccgggatcgccctgcatctctttcggagttccatccatgatatttgcaatgtcaacatttgcttgcaggacaggtgttgctttttttacaaacgagatgttgctttcactcaaactgttttcaaataacttggcatctttctcattcatgaatgaaaaatcagccgctacattttgttcagcggtcttttccgacgagtaatacgagatgtaagcaagagataacagcccgatggcgagcgctgaaacggttgtaataatcgtcagcagcaatgcgttcgatttcattctgaacatgatcgatgacagtgacagaacctcagaaatatttaagtagccgcccttgctttttcgaatgatattcgagataaacgtaactgatcctttataaaacaaaaacgtcccgataatgacagcccccaagataaagctcatcgcgccaaacagttcgttaatggtcttaaattttccgccaaacagctcagaagacacatagtatcctgtcaaaatcagcacgatgcctaaagcgccgatcagcatttggaaaaaggatattctcttcactttatcttcagtggaggacgttactttaaacaaagataaaatactctgttttttgataaacgtataattcatgatcatgatcaaaaggtaaatgccgcagaacacaatgaccgtttggaccaaggcctgctcagaaaaatgcagtttcgcatccgatttgacatcgacaattttgaacagaatcatcaagaccagcttcgatatcgaaaacccggccgctaccccgatcgctaatgaaccgaaatacagcatgacattttctgcacttaagatgcgaaaaattttatgcttcgtcattccaattaattgaaacagcccgatttctttactccgtctcttaataaaaatcgtattggcatataaaatgaagatcgccaccacagccacaagcaaaatcgaagcggttttaatagccgcagctcccttaattgaagccttcacttcgttaattgctggatcatactgcagcgtgacaaaggcgaaataaagcgccacgctaaagatgagcgcaaacacatacagatagtaattccgaagattctttttcaaatttcgcaggatgagctgattaatgttcatgctgcaccccgcctaacacgccttgcgttttcataatatcctggaaaaacgtctgcctgtcctggccccctttattcagctgtgtatacatttgcccgtccttaataaaaatgactctgctgcagtagctggcagcgacgggatcatgggtaaccataataatcgtggcgtttcgtttttgattgagctggctcagcttatttaatagatcagaggccgatttcgaatcaagcgcgccggtcggttcatcagcgaaaataatgctcgggtcatgaataaacgctcttccggcggatgttctctgcttctggccgccggaaatttcattcgggtacttatcccgcaattcatatattcccagttcctttgcaacttcctcaaacttgcgattggcttccttttttgatagtttcgtgatcgataaaggcagaaggatattctctttcactgtcaatgtgtctaacaaattgtaatcctgaaagataaagcctaaatgctgttttctaaattcagccagctgcttttccttcatagctgtcatgtcatttccattaatatgaatggttccgtgactgacctgatcgattgaggacagaacgttgagcaaagtggtttttcccgacccggaagcacccataatactgacgaattcgcccttttcaatgtgaatatcgatgcccttcagcacttcctgtttattcagcttgtttccataactttttcgaattttattcgcttctaaaatcaccatttacgcagtctcctttatattggataatctcattataaaaaggaatgccgggcttttccttcgatacggcgaacaaaaaagaaaagcatgtgacattttcgtcacacgcttatgacatgttcaaattgattccgtattggaaaggttaatgtaaaaactgtccccgcaccaaactccgactcaacatcaatatggatcaataacggcgccgctgctttttttgccaagtacagccccatgccagttgacgcttgatcatggtgatccgttgtggatgtaaaccctttatcaaaaatacgcggtacatcttttggatcaatgcccctgccacagtctttcacttggagctgcgtctgttcccctttttgaaagcttttgatctcgatttcagaggcttcgctgtatttcaccgcgtttgtcagcagctgcctgatgataaacgccagccattttgcatcgctcagcacttcttttgcatcgagctgtatgtcaaaaccgatccctttttggatacaccacgattgtaaatctttgatttctttaaagatcaaaggctgaagctgaatgaattctactgacaggtcgttttcaataaatgaaatgcgtttttgatgaagctgctgatcaagaagcaggtgaatacgcagccattcatatgacagctgggatttcagtgctttttcttccattctatcaatgattaaatgcatcgctgttaatggagttttaacctcatggatccatgccatcagctcatctttttcattttccaatgctaagcgatgccgtgctgcggtctgcttcaagtgttctgtttgcccggcaatgcttctttcaaccattgcttcaaacggcgtttccggttcatttatggctgtcacatcgagattgttctcccatgttttcaagcttttataaaacgctgtttctttccgatagcggaaccaaaggaatatgataaaaaacaagatgcacaaatacaccatataaagtacattcccgaatgatatggaaggatcgacaaaagcaatgaacagcatcaaagcctgctgaaacaaaaacgcggcaatccagctccgcctttcgataaggaatgctttaatcatagaacttgtcctcttccttcgcgatgtagccctggcccacctttgtctcgatatatgcgccaagctgcaggacgtccagtttttttcgcaggcgattgacattgacggtcagcgtattatcactaacaaaacgctcatcgttccacaagcttctgatcagctcttcccggctgacgatcttgtttttttgctctattaattgttttagaatgaacatttcatttttggtcagttcaacagatcctttgtcattgctgacgaggttctgctccgcgtctacagcagcgccgcaccacgttttaatcgtactcggctccgtattataatggtgcacacgccggaacattgcttggattttcgcaatcagcacatcaaaatgaaatggcttttgaataaagtcatctgccccgagctgcatggacatcaccatatcagcaggatgatcccgggaggataaaaagagaatcggaacatttgaccgggagcggatcagccggcaccaatgaaagccgtcaaatttaggcagctgtacatcaataatgacacaatcaggattaaccgccgcaaattcctgcagcacctgactgaaatcctgaatgccgtatacatcataggaccatcccgttaaacgatccttgatttcatgaaacagcgattcatcatcttcaatcagcaaaagtttaaacaatcaactcaccgcactttttccttttttatcaagtgtatagcaaaacgccagcatgcgctatagaaaaagccggctgtctcagccggctcgttcacattataattctcttctcaacgctatcagcacgttggttttggttgcttttctcgccgggttcattccggaaatgactgcgacccctccgcaaatcacaacggcaatgatcacaaggctcgccgggatgtaggagaatgtgtaattcaagtcgcccgcatcgcctccgcttgtggccgcgagaatcatcggaacggccaggttgacaaggtagctgacgccgtaggaaatgataattccaatcacacagcctaaaatcccgatatacgcgctttccatcaggaacattcggcgaatgatagacggactcgccccaatcgctttcataatgccgatctcttgtgttctctctgtcaccgccatcgtcatcgtgttaaaaatgccgatcgctgaaatgataactgcgatacatccgacaaagatcagtccgattttgaagaccatgaagaaggtgttggcccctcaagttcggtagtcactgatgtgacatagtacccgtcatctgttagatcatttgtcagctgttccacattctcaaacttatcagcaaaaacgccaatcttagtttcaacatttccgtctttgaaatctaagaattccgaaaaatcttttttgaattgatcactgataaaaatgtttgagtcctccatccagtcttgagatggtttttttgtaataccgacaattttaaagtcatatgtttttgtttttgtaacatcccctgttttaggatctgtcttcgatacacttagttctattgttttattcagaatatctttcgtatagccctttggttcttttatatcttctggatttccttttgcttcctcgatttttttgttataatcttccgattcttttttcgttaataatctctttgcgaagtcgtatcctactacgatttcattttccgactttgcgactcttcccttttccaattccatattggcctttaattcatcattcatattagtaaaaatgagatttgagctttcatttgtacgattgcctaaagtagctttgtttggttcatacacttgcgttctttctacaactgaccttacgtgatcatacttctctaaatcagcttttttaataggcttgtctccttccttgcccattacactgactttcgttacaacctgctggctcattgtcatatctgtaattgtcttttgaatcccaaacccaacggacgacagcacaaccaaaaacgcacacgccattgttgtcgcaagaatcgtcataaagacgcgaagtctgtttttcttcatatttcttctgataaaatgaacctgatccttaaacctcaacggtaattcctccttttagcacaccatcatgaagctgaaattttgaatgtccgatagaagcgacttcatcatcgtgagtaatgatcacaaatgtaatgccacgctcacgattcagctgctggatcaattccagcacttcatgttccgtttctgaatcaaggcttcccgtcggctcatccgctaagataatcgaaggatttaaaatcaacgctcgagcaatactgacacgctgctgctggccgcctgacagttcattcggataatgagcggcatggttttccagaccgacgcgtttcagcatgtcctgcaccttttgcttccgctcagatggcttgattccttttaacgccagcggcatttccacattctcatacgttgttaagcccggaatgagctgaaagctttgaaaaataaacccgaaatggtcaagccgaaattgcgcccattccttttcattaaaccccgtaacatcagtgccattaatgacaatccgcccttttgtcggcgatatgtagccggaaatcaaattcaaaagcgttgatttccctgagccgcttcgcccgacaatacaggcgatctcacctttcgccacacgtaatgaaacatccttcaatactggaacttcattctcacggcccttttttccgatcgtgaaagaatggtcgatatgctgaacatcaatcatatgttctctctcccttacaaaagtttcatttttttataaatcgcaaaataactaatcaagaaaccgattaccgcacctgtacccatgccaatgagataaccggcaaagctctcgcttgccgtaaaaccaaaatagccgaagcccatgattcctatgataataacgatgatctgcaccgggcggttaagcggcttccataagaagaaatatccgtttctttcattagacagtttgacaaagctaatatagccgataatgtaaaaaatgatagtcatgatagccggaatgactaaataatatggtgaattctcagcccatttcgagtctacataaattatcggaatgaaatactgcacccatttaggtactggaccatggataaaatctattgatccgccaaaaaggatctccaggttgattgcaggcaggctgatgagcaaaaatggcgaaatggccacggtaaatgagaccaaaagctgggcaaaaatatttcctgtcagagctcctcctgccataactagcgaataagccagcatgctgatgatgatcattccaaggctgtaattgtgaaaataatcggcctgatcaggcttcaaaagcatgatcagcaaaacagataaaacataacctatgagttgcggtatcacaatcaccattccgccattaaggaacttcgcatgaaatatctgccctcttgtatacggaaggcttaatgtaaaatcaaaaaagctcttgcttcgttcaatccctagctggctgaccgccaaaacgactccccaaatccaaaacaatgagataaatgagctgtttaaataatcaacgctgaatacgcaggggccgacccaattttcttttccagtgacacagccttgatagatgagatacatatttaaaattgataatggattacccaatataaaaaccaaaatggtgataactaaggcgactttattctgccgccactctttgtaaagcagtcctgaatccggcaactcacttccctccaaacctaaggcatttcttacacttttgttttcttataaatagagaagtagctcacaaagaatccagccactgccccaatgatcatacccaaaatataaccaataatggaatgtccggtatagtatccaaataaaccaaatccaaggatgccgaaagccataaccagaatttgcaccggacggtctaatctgttccataagaaaaagtgtccgtttcgttcactgggatgctttttgaagcttatcaaaccaatcaagtaaaacagaatgctcatggcagctggaatcattaaaatatatttactatcgataagccagtcacttgcaacataaccaatgggcacaagatataataaattgctcgtcagagagaaatacacctccggggaaggaaatatttcccatatattcacaccaaaaacaacttcaaagtttccaaccggcaatgcaacaattaaatatggcaataccgcagcagcaaatgccgttaataactgggcaaaaacatttcccgttaatgcaccagcagccatcaacaaacaataagccataaaactaatcacaattactccaacgctgctgtgctcaaaaaagtagacgtgttcagggttatagacaagaatcagcagccacgcaaataaaaagccaattaattgcgacaccacaatcacaaaaccgcctaaccaaaatttcgtctgaaaaatttggcttctgttatatgggaggcttaatataaaatccatcgtgcctttcgaacgttccattccgaggaagcagaccgccaaaatgaccccggcacccagttgatatctattagattgcttctatgataattcacaataaattcacaatattgcgggtcttgatgagccagacacccttgataagacaaatacgtattaacgatagaaagcggatttgccaacactaaaaacacgatacttaacaaaatcaccacttgattctgtttccactctcgatagaggagacctcggtctaccatctccgcttccctccaaacttcgcaatgaacacttcttccaggttgacaggaagctcattccatacttttggcttcagctctctcaaaaagctctttttctcctcatcgcttttcggaatcagcactgtgtaaaacacgccggcctgatcgagcatcggaatgttttgctctctgatggccaaattgacatctgtatcgaaagccatttgaattttaatgtattcttcttttaactcatcaagatccatgacgttggtcagtctattatcttcgagaaaaccaattcggttgcacatccgttcaatgtcctcaaggcgatgggaggtgatcaggatgctcgtatcacgctctgccacttcatcgaccatcagctgcagcacatcatgccttgtcaccgcgtctattccatccgtcggctcatcaagaaggatcagcgccggtctcgccgcaaacgacagaacgagggacagctgttttttcaagcctgtcgacagttcgcgatattttttcgtttccggaatttcgtacctgttcatcagctcattcgcgtacgtgacatcaaattttggatatattcttctcaaaatatcgactaactgcttgtatgtatacttatcgtaaaaaggattttgaacaggcatgtagatgatattttgtttgaccttcgggtgctttttgatttctacgccgtcaaataaaatcgttccgctgtcagcgaaaatgatttgctggattaagcgaagcatcgtcgttttgcccgatccattgcgtccaagcaatccaaagatttctcctttttcgattgttaatgaaacatcttttaatacttgattgccgtcaatcacttttgacagctgccgcagttcaatcattttttttgcctcccttcacatcagcgctgatttcctttatccattcgtgcagtttttccagctcaacccctgcatagtgtgcatcgatgatgagctgtttgagttgctctttaatcatcgtcatcttcccttcaaccagtgtcgtttttgcattctccgatatataggtccctctgccccgcagcgtttcaataatcccctctcgctcaagttctttatacgctttgctgacagtgttcggattcgcaataatgatcgttgccaattctctgacagaaggaagcttatcaccaggcttcatgatccctttcaaacaaagctctttcatttgctgaataatttgttcgtaaatgggtgttgagcttcttggatcgatttgaatcatttacttccctactttctatacgatctgaaccttttatagataaaaatgatcaattatacttttttgccattcaaaaccgatcatcacaagaacaagaaaaaaagaacaagcgatcacagatgccgcaatcagcattggcacgttacgtttgtttcgatttttacgtttcataactgcctcccttaacgtcaatatataaaagattttatattagtgtctatagtgtattacttcaattagtacacttaatacaataaatactttgactcacaaagtcaatcctttttttacaaaaaaacggacccttttaaaagggtccgttttcctacacatcaagagggtgctgcaggatcatattattttgcaaagattgaagctgaagtctcattctgtacagctgttctctttgctgatcatttgacgacagccatagtttattcaaggcatttaccgcatcttctagctgcatttgtgcatcactatattcttgatcgttataatgctcttgtttagaagcgattttcagctgttcttcagcataatcataggcctgcatacattgctggagatgttcatctactgattgtcttgttgccacagtaacccctcctcttggtaatggaaatcatccatcattcatattgtagcctcatctgactttattcaataaagtaatttatggtcgatattcatttgttctcttgtgaaatgcgtgctacaattttaggatgcaatcgtacgcaaggaggcacatgaattgtgatgcagaacaatccttttccttattcaaatacggaaaaacgctatcatacattgaattatcatctcagagaacatttcggccataaggtgtttaaagtagcgcttgacggcggttttgactgtccgaatcgggacggcaccgtagcccacggaggctgtactttttgcagcgcagcaggctccggcgattttgccgggaaccgggccgatgatttaattacgcaattccatgacatcaaaaaccgcatgcacgaaaaatggaaggacggcaagtacatcgcttattttcaggctttcacaaacactcacgccccggttgaggtgcttcgtgagaaattcgaatccgtcctcgccttagatgatgtggtcggcatttcgatcgccacacgcccggactgtctgcctgatgatgtcgttgattacttggcagagctgaatgaacgtacgtatttgtgggtggagcttgggcttcaaacagttcatgaacggactgcacttctgatcaaccgcgcacatgattttaactgctacgtggaaggcgtcaataaattaagaaaacacggcatacgtgtctgctcgcatattatcaacgggctgcctttggaagaccgggacatgatgatggaaacggcaaaggccgtcgcagatttggacgtccagggcattaaaatccatctgcttcacctactgaaaggcacgccgatggtcaagcaatatgaaaagggcaagctggaatttctttctcaagatgattatgtgcagctcgtgtgcgatcagcttgagatcattccgcctgaaatgatcgtccaccgcattacaggtgacggaccgattgagttgatgatcgggccaatgtggagcgtcaacaaatgggaagttcttggcgccattaataaagagctagaaaatcgaggcagctatcaaggaaagttctttcagcgccttgaggaggaatcagcgctatgattttgaagaaaattctcccttatagcaaagaactgctgaaaatggccgcgggagaaggagatattgtcgtagatgcgacaatgggtaacggacatgatacacagtttttagcggagcttgttggtgaaaacggccatgtgtacgcattcgacatccaagaatcagccgtggccaatacaaaggaacggctcggtgacatgtatcaagcgcgaacaacgttatttcacaaaagccatgataaaatcgctgaatccctcccgcctgaaacacatggcaaagtggcggccgcggtatttaacctcggctatttgccgggcggggacaaatcaattacgacaaacggaagttccacgatcaaagcaattgaacagcttctcagcatcatgaaagatgaaggtctgattgttctcgtcgtctatcatggccacccggaaggcaaagctgaaaaaaacgacgtgcttgagttttgccgggacttggaccagcaatcagcccgtgtattaacatacggatttatcaatcagcaaaatgacccgccatttattgtcgccatcgaaaaaaaagctcagatcagcaaatgatttgagcttttttctttgagtttttcatccaggacattttttgaaatttccggtaggctctgccgttgatataaaagaaaagggaggtttttccgctggctttgatcagcttctttgcgagccggcccatttccttttggcctgccactttatcatctgacaaataaacaccaagcaagccgcgattgattaaacgatggaagttttcatgcggaatgccttgtagatgctcgtcggctttatggataaagtgttcaagccgattcatcatctcttcatgagactgataatacgagcagaaattcaagtctccttccagcaagtcctcctcttgatcaatcaaataatcaagaagaatatgaagaccctgtatgtaaggaaaataactgtcacggatttttttagcggtgctttctgtgaaatcaggctggaacgaatacgcaaccagacagaaaatgcctaacgttgagcctgcacaggctgaaaattcataccattccatctcaggcagctctgattcatattgagtaaaccacttttcaagccgcggaacacgctcatgctcaataacgtgcttatgcacctgcaaatcgcaataatagccgcacagttcaagcagataaggtttaatcatgtcatagtgctcaatggaaccaaggacacgctggcacgttttgaccagttcgtgcagatatccgctgtcatcctgttcttccctgaattgataataattttgcagttccgctcccactgtcagtgcgtcctgcattgaggcatggagcatccgaaaatcctgcgggtccagcgaggtgctgcggtcacatagattgtccaaataatcactaatcgtttgatacgcgatgataaactcgacacatttctgcttttggctgcctgacaataaggccagtatgccgccgccttcacagtgaaacgttttgtcccgaatacttgcggttgcctgtgctttcaattcactgttatgaatcgattctgatttttgcttccatatgtccagctcttgatgaacgagcggaaaaatatctcgatatacctttgtcatcaatccaaaaggatgttccggtactgtcaacacatgcaccccctactagttcaaatatattgatcagtaaacgctcttgctgctttaaagacatcttctctctcgggttcattgaagatctcatggtaaagcccttcccactctctgtatgctttattatgagaagcaacaccattaaaccacttgatgaccatcgttttgtcaacaagcttgtcatcaccggcttgcatcacaagaagcggaactttcaaaaatgcctctgtcggcaccattgccgattcaattgtctttaaaagctctctgtaccatctgacagaaactttcctgacgtataacgaatcattttggtcagcctcgatgacgtcctcattgcgcgtcgccatatcaattgataatcccgaatcaaccttaagtgacggagcgatgacattcaggccttttgatgcaagatcaagcgctttattgactttaatttgcagtccgagacacggtgatgataaaataattcccgtaatccggggatttctttgctgtttaacccattcaatcgcgaccagaccgcccatgctgtgacctagcagaaaaaccggcagatcaaaggttcgcgctttatctatccaagcatctacttcatcaatgtattcttgaaacgagcgaatatgccctctcgctcttgtcgttgttccctgtccaggcaaatcgcccatgacaacgtgataacccgaagaccgccacatttcaatcagccatttatatcgtccgtgatattcacttgccccgtgaatgattacaatcactgcaacaggtctgtctgctttccaggtccacatgctcttcacctcatacgaaatttaaatagagaaagaaggatgaatcttatgatctacccttataaggaacacaagccagatatccacccaacagcctttatagctgataatgcaacaattaccggtgatgtcgttatcggagaacagtccagcatttggttttctgttgtcataaggggagatgttgcaccgaccagaatcggaaacagagtcaatatccaggatttaagctgccttcatcaaagcccgaacaagacgctactcattgaagatgacgccacgataggccatcaggttacacttcatagcgctgttatccgcaagaacgccttaatcggcatgggctcaatcattttagacggagccgaaattggcgaaggcgcttttattggtgccggcagtcttgtcccgcccggaaaaatcattccgcctggccatctcgcctttggccgccctgcaaaagtcatccgccctttgacggaagaagaccggaaagatatgcaaagaatacggtcagaatatgtagaaaagggccaatattataaatttcttcaacaaacataagacctgcttcgtcttactttaccatttttcaaattatatttgaaagcaataaccatcgttaacccggacgtcatcacagttcgggtttcgatttttccataaaacgttcacatatagcatgaaacgtatgacttttatcttatcacaaaactataaacagcctctgcaaaaacacatacctattctttcctgttctctattttctatgagcacacacaaaaagagcccactgggagctctttttgtcagctgatatttcgttcgctggcagcagccgcatttttttgtgaaacccttttccatagtacacagccagcaagatgagaaaccatatcggcccgataatcacggctactcttgtatcagggctgtaagccataagaatgacaacgaatgttagaaatgccaatgacacataagacgtaaacggaaataaaggcattttgtactttaattgtttcttttcttcaggcttcaaacttttcctgtatttgatttgagaaagcaaaatgatcgcccacgtccaaatcgctccgaacgtcgcaatacttgtaacccaggtaaataccttcgcagggacaacgtagtttaacagcactccgactaataaagcgcccgcagaagccagaacagctttacccgggatgccgcctttcgtcagctgaccgtatgcttgtggggcctctttctgttccgccaagttaaacaacatccgccctgtgctgaaaataccgctgttgcatgaagacagcgcggctgtcaacacgacaaagttaatgatgcctgcagctgatggaatgcccactttttggaacgtgagaacaaatgggcttccctgagagccaatttcctgccacggataaatagacataatgacgaataaagcgcctacataaaaaatcaaaatccgccaaaatactgtatcaattgctttggctaacgatttttgcgggtttttcacctcgccagccgtcaccccgatcatttcaatccctaaataggcgaacatgaccatttgaagagacaatagaaccccttttaaaccatgagggaaaaatcctccgttgttccacaaattactgattccagttgcaatgcccccattaccgactcctgcaataatcatcaataaaccgacagcaatcatggataagatcgcaacaattttaatcaatgcgaaccaaaattccagctcaccgtaagctttgacagccaggaaattaacacccgtcataatgaccagcgccgataatgcccaaatccagtttggcacgtccggaaaccagaaccccatatagatgccgacagcagtaatttcggccatacaggtgacaacccataaaaaccagtagttccaccctgttaaatagcctgcaagcggtcccaaataatcacgcgcatacctgctgaaggagcctgcgaccggtttttgaatggccatttccccaagcgctctcataataaaaaacatgaccaggccgcttgcggcatacgctaccaaaataccaggccctgctaattgaatagctgatgcggagccgaggaacaaccctactcctatagcagctcctaaagacattaaagaaatatgcctttcttcgagtccgcggtgcagctcttgtttttgtttttgcatgctttcttctcccctagaaaaaaatatcattatatcatttttctgaatattccgtacggattgggtaaatcaatgatgatggagaaataaaaggataacaacaaggctttcgactactcgaaagccttgttgtatgttacacaaagatgacttctttaggctgatggctcagctcttcaggcatataccgtttttcaatattgatgctgtgccagatcataaagatcagtacagtccagattttccggctgttatcagccttgtccgcacaatggtcttcaagaagctgaaggacataatccttatggatataagcatccgtttggctttcctgaataatattccgcacccattcgttcatttcgtttttcagccaatgacggatcggtacagggaaaccaagctttttgcggtttaatacatgctcaggcacaattccttcagcggctttgcgaagaagatacttcgtcgtgccgttcttcgttttcagctcatcaggaatttttgaagcgacgtcgaatacgactttatccaagaacggcacacgcagttccaaagaattcgccatcgtcattttatccgcctttaacaaaatgtcgccgcgcatccaagtgtggatatcgacatactgcattttgttgatatcgctgtacgagctgctttctgtaaagtaagtcttcgtcacatcgcgatatgaaaggttcggattataatgcttcaacagctgctttttgacagactcttcaaagattttcgcgttaccgatataacgatcctgaagcggagtacagccgcgctcaagcaggctctttcctctcataccttcaggcataacggcagcaacgtgcagaagcatctttttcaagccggacggaatccgttcaaacggtttaagcgaaagcggttcacggtaaatgttatatccgccgaagagctcatccgctccttcacctgataaagcaaccgttacatgtttttttgcttcttttgcaacaaagtacaacggaatcgctgccggatcagcaagcgggtcatcaaaatgccaaacgatcttcggaagctcattcatgtattcctcaggcgaaatgactttgctgatattttcgatgcccagcgccgctgccgtttctttcgctacatcaacctcactgaagccctgctgttcaaagccgacagagaatgtttttaagcttggatgaaattccttcgcaacagacacaataaaggaagaatcaatcccgccagacaggaatgaaccgacaggaacgtcacttctcatatgaacgtttacagagtcatagatcgcgtctcggacttctttcacaagcttgtcttcttcagtctgaaccggcttgaagttcgctttgaaatacgttttgaatgtgatatcgccgtccgggcggattgtgaactgtgaacccggctctacttttttcacatgggcatcaagcgtgctcggttcaggaacaaattggaaagacatgtactgctgcaatgcctctttatctatttcaatatcattctgagcaaccattaaactttttctctctgaggcaaaataaacctgatcattgattgttgtatagtacaacggtttaatgccgaatggatctcttgctccataaagcacatgatcgtttttattccaaatcagaaaggcaaacataccgcgcagtttggacgccgcttcttctttatagtgacggtaagtcgcaagaagaacctctgtgtccgaatccgtgttgaatgtgtacccctttgcttcaagttcttctctcagttcaatatagttatagatttctccgttaaagataatccaatatgtttcatcttcatatgataaaggctgtccgccattttctacatcaataatgctgagccgtctgaatccgaagccgacgtgctcatcatggaaatatccatcactgtcaggaccgcggtgaacgatcatttggttcatttgtttgattagttcttcttgatcagcggtttgagctaacggatgcttgttaaaaaccccgacaaatccacacatagtattgcctccataattaaaattgtcatcattgaacccctatttatagacgctgtgaatagtatttggtttcacagttatgtaaaaaaataaacatgaatacaacgataaaaaagggaaagccgcttaaccagtaagcggctataaaattattctcctaacgcttctttacgcagctgctccgctttgtctgtacgctcccaaggaaggtcaacatcgtgacgtccaaagtggccgtacgcagcagtttgtttgtagatcggacggcgcaaatcaagcattttgataatgccggcaggtcgtaaatcaaagttattgcgaacaacttcaatcagtttttcctcagaagcttttccggaaccgaatgtgttgattgagattgacacaggctgtgcaacaccgatcgcgtaagcaagctgtacttcgcaagaatcagcaagctcagccgcaacgatgtttttcgcaacgtatcttgccgcataagctgcagaacggtctaccttcgtcgcgtccttacctgagaacgcgcctccgccgtggcgtgcatagccgccgtacgtatcaacgatgattttgcgtcctgtaagtcccgcatccccttgagggcctccgattacgaaacgtcctgtagggttgatgaaatattttgtttcttcatcaatcagctcttcaggaacaaccggattgattacatgttctttaatgttgcgctgaatttgttcaagtgtaatttcagggtgatgctgagttgaaataacaatcgcgtcaatgcggactggtttgttattttcatcgtactcaaccgttacctgtgttttgccgtcagggcgaaggtacggaagaatatcttctttacggacttcacttaggcggcgggctaatttatgggcaagtgaaattggaagaggcataagctctttcgtttcgttgcacgcataaccgaacattaatccttggtcacccgcaccaatcgcttcaatttcttcgtcgctcattgtgccttcacgggcttcaagcgcttggtctacgcccatcgcgatatcagcagactgctcatcgattgatgttaaaaccgcacaagtttccgcatcaaatccgtattttgcacgtgtgtatccgatttctttaatggtttggcgaaccgttttcggaatgtcaacatacgtagaagttgtgatctctccgcttacaagaaccaaacctgttgtcacagatgtttcacaagcaacacgcgcgttagggtctttctttaaaatttcatctaaaatgctgtcagaaatctggtcacagattttatccggatgcccctccgtaacagattctgatgtaaataaacgacgatttttactcatgatttgcttcctcctgcacaaggcctcccgaaagaccttgtatatatgatacggaactcgctccctcttatacaatgtacagttatattagagaatgttaattggcatatttatgaaataaaaaaaccttttccatcgaggaaagggtttggtctttgtgcctttcactcttatcgctcaaggaatcatacaaccttgcaacaggttagcaccttggttgtctcactcagttgaacataataaataacagagaaaccggttgctgggcttcatagggcctgtccctccgccagctcgggataagagtatccgctcaatgaaatatcttatcgtaaaagggtttgcaatgtcaatatgattcagaagaaataggcacctatattgagggaaaacaatggaaatgcacacacaaaaaataataaatagtatagactatttgaaaatatatgttatactaattcacaattagcaaaacacaaaaaacgataaaggaaggtttcatatgaactcagttgatttgaccgctgatttacaagccttattaacatgtccaaatgtgcgtcataatttatcagcagcacagctaacagaaaaagtcctctcccgaaacgaaggcattttaacatccacaggtgctgttcgcgcgactacaggcgcttacacaggacgctcacctaaagataaattcatcgtggaagaagaaagcacgaaaaataagatcgattggggcccggtgaatcagccgatttcagaagaagcgtttgagcggctgtacacgaaagttgtcagctatttaaaggagcgagatgaactgtttgttttcgaaggatttgccggagcagacgagaaatacaggctgccgatcactgtcgtaaatgagttcgcatggcacaatttatttgcgcggcagctgtttatccgtccggaaggaaatgataagaaaacagttgagcagccgttcaccattctttctgctccgcatttcaaagcggatccaaaaacagacggcactcattccgaaacgtttattattgtctctttcgaaaagcggacaattttaatcggcggaactgagtatgccggtgaaatgaagaagtccattttctccattatgaatttcctgctgcctgaaagagatattttatctatgcactgctccgccaatgtcggtgaaaaaggcgatgtcgcccttttcttcggactgtcaggcacaggcaagaccaccctgtcggcagatgctgaccgcaagctgatcggtgacgatgaacatggctggtctgatacaggcgtctttaatattgaaggcggatgctacgctaagtgcattcatttaagcgaggaaaaggagccgcaaatctttaacgcgatccgcttcgggtctgttctcgaaaatgtcgttgttgatgaagatacacgcgaagccaattatgatgattccttctatactgaaaacacgcgggcagcttacccgattcatatgattgacaacatcgtgactccaagcatggctggccatccgtcagcaattgtatttttgacggctgatgccttcggagtcctgccaccgatcagcaaactaacgaaggagcaggcgatgtaccatttcttgagcggttacacgagtaagctcgccggaaccgaacgtggtgtcacgtctcctgaaacgacgttctctacatgcttcggctcacctttcctgccgcttcctgctcacgtctatgctgagatgctcggcaaaaagatcgatgaacacggcgcagacgttttcttagtcaataccggctggaccgggggcggctacggcacaggcgaacgaatgaagctttcttacactagagcaatggtcaaagcagcgattgaaggtaaattagaggatgctgaaatgataactgacgatattttcggcctgcacattccggcacatgttcctggcgttcctgatcatattcttcagcctgaaaacacgtggaccaacaaggaagaatacaaagaaaaagcagtctaccttgcaaatgaattcaaagagaactttaaaaagttcgcacataccgatgccatcgcccaggcaggcggccctctcgtataaaaaacaaaagccaagagcaattatgctcttggcttgttttaattgacggaatgcaaagaagtcagcttgtatgtaatgatggtccggccttcttcccattgaagcttctgcacttcagctgtgcctgacttttcgccaaactttgttttgcgtacatccattggaatctccatcggatatactcggtatccgtccttctctaacgtgaatatattttcatctatgcgaacttcttttccttttgtcacaatcagtgtattaaattcaacaggcattcccaaagtgaaatcccctttcgttctcttttttctttatcataacatatttcactgtcagcggtttttcatccattgtgtgagctgccgtacgatacgccggttttcttttggcgggaaataatgtgtgaatgtactgtagtaccatgtctccaccggcttatgcagttgttttagcttctcttcaaataaataggaatgctgaatcgaaacattttgatctttttctccatggattaacagcacgggagcctgaattttgtttacttggtcaaacggtgtcctccattgatattcctcaggcacctttttcggtgttccgccgatgactcttttcatcattcgccgcaaatcctgccgctcctcgtatgtaagaatcatatcactgacgcctccccaggaaacaaatgaagctgcctgcctgcccatttcgatagcagtaagcattcccataattccgccgcgggaaaagccgaagatgtggactctatccttcttgacatttgggtgctgctgaagcaggcgaaaagcagaaaatgcatcctccctgtcttctccggcaaaatcctcattgccttctcctccttgatttcctctgtaaaaaggagcaaataccacaaacccttgggatgcaaactggataatccggcctggccgaaccatgcccacgcttttaatcccgccgcgcaaatataaaaatccgtcatattgtcccggttccgccggctcagccagaagccccttaacccgtaatccatttgacaggtagcagatcgtatacaaacgcacatgctggctcggcgacggaaatctacttttctctacaatcaaaacagccgcctcctttttttctatatgctttccttactccaaaattacatccggagaacctggttaggcattcacacatttttatacccatcatacgatatgtaaagcaaaaaaggatattaacttgatgcgaaataaggaggttgtctatgtgaacagatggttaaggctgggcttcgcctgtgtcggcagtatctttctcatgatcgccctggcggcttgcaagcaggaagaaacgctcaccaaagtcaaagtagctgaagtgacccattcaattttttacgcacctttatatgttgctgagtctaaaggtttttttaaggaagaagggcttgatgtcgatgtgaatacgacctggggcggagacaaaacgatgacatcgcttctttccaacggctccgacatcgcgcttgtcgggtcagaaacatctatttatgtcgaagcgcaaggggctaaagatcccgtcattaatttcgcccagctgactcagacagacggaacgtttcttgtcgcgagagaagatgttgaacacttcgactgggatcagctgaaaggaaaaacgtttctcggccagcgaaaaggcggcatgccgcaaatggtcggcgagtatgtgctgaacaaacataagattgacccgcataaggatatagacctcatccagaacatagacttcgccaatattgccaatgcgtttgcttctggaaccggtgagtatgtacagctctttgaaccgcaggcttctctctttgagaaaaaaggcatcggccatatcgtggcttcattcggagaagaatcaggagaggttccttatacgacttttatggcgaaacaaagctatttgaagaaaaatgaaagcacagccgtaaagtttacaaaagccatttataaggcgcagcagtgggttgaaaatcattctgcgaaggacatcacagatgccattaaagatgaatttgatgataccgacccagacgtcatcgaaacatccattgaacgctataaaaaacagcattcatattcgccagaccctctgcttaacgaaaaagaatgggagcttctccaaaccattatggatcaatcgggagaactgccgaagcacattccatacaatcagcttgtaaataaagaaattgctgaaaaagtcacctcggagaaataggaggcgccatctatgtctttcttacatgtcgaccatgtaacccatacttatttttctattaaagaaaaaacaacggctgtgcgggatattcatttcgatgccgaaaaaggcgatttcatctcatttctcggtccaagcggctgcggaaaaacaacactgctttccattattgccggtttgattgagccatcagaaggcagagttctgattgaaggccgtgagccgaatcaaaaagaacataatattggctatatgcttcagcaggattacttatttccctggaaatctatcgaggaaaatgtgcttctcggtttaaaaatcgccgacacgctgacagaagaaagcaaagccgctgcactcggtctattgccggagttcggcctcatagatgtggagaaaaaatatccgaaagagctgtcaggcgggatgcgccagcgggctgcgcttgcaagaacacttgcgcctaaccctagtctgcttttgctggatgagccattttccgcgcttgattttcagacaaagctgtctttagaaaacctggtattccgcacattaaaggaatatcaaaaaacagcagtgcttgtcactcatgatataggggaagcgatagcgatgagcgatacgatctttttattttcaaatcagccgggcaccatccatcagatttttaccattcctaaggaattggccgcgatgttgccttttgacgcccgtcaggaaccttccttccagacactgtttcaaacgatatggaaggagctgaattctcttgagaaacagcaaagaaaccattgatctgcttcacgagcagtatcaattcaaacagaaaaaggaaaagtggaaggtccattcctttcagcttgccatatttattctctttttctcgggctgggaaacctccagcaggcagggctggatcgatccgctgatcttcagctctccatcagctgtgtggcgattattgctggagaaacttggtgacggttctttactgtcacacatcggcgtcactttatttgaaacggtgcttggctttttgcttgggacgtttatgggcacgtgcctcgccgctttgttatggtggtctaaccgacttgccagaattttagatccgtatcttgtaattttgaatgcaatgccgaaagtggccctgggcccgatcctgattgtcgcgctcggtcccagttttatcagcatcattgcgatgggagccatcatcagcgtcattatcacaaccatcgttgtctataccgccttccaggaggtcgacgaaaactatacgaaagtcatgaaaacattcggcgcaaaaaagtgggttatttttaaagaagtcatactgcctgcatcctcccccgcgattatttcaacactaaaagtgaacgtcggtttatcatgggttggcgtcattgtaggggaattcctcgtttcgaaggtcggattaggatatatgattatttacggattccaagtcttcaattttacactcgtcttcttaagcctgctgatcatcgccatcttcgccactctgatgtatcagggcgtcgagctgctggaaaagaaatggacgaaggggaggacataaaaaacccggcacatgtgccgggttttttattcaatccatccagattctttcagttttttcaaactgatcggaagtacggaatccttcataataaagctgaattttttattgcgggaaaggttctccggaagctcgtgaaacaaaaccgggcctttcgtttcaaagtaatcagcttgcttttcaagcttttctatatctgcaaaatatatatttttcacaatcactttttcttttccgagaactttatactgtccgagatacttgaggcttttgactctcgcgcccgtctcttcctttacttcccggagcgcagcctcttctgcgcactccatcggctctactttcccgcctggaaactcatagcctctgtcctcatgttctgttaaaagccatttgccgccaaaacggcaaatcacccagacatgcttcgggctgtccgagaaaggctgatcgtcaaaggaaagctgaacagtattctgataataatctttaaactcgtacatgtttatccctcaaatccgttcctagctatcttccatacatcataccacagttacgtttcttcggaagccttttatcaaaaaataagggaaacccagcacgccgtcaggttctgcatgcagactagctcgtacagtttttttgcgatagcttttgccgaaaagtgcgaccgacgctctgggctttattatgacccgcgaacagggaaaagttacggtttgcgcttaaatttattttttaacgtttctaaaagatcgacaagcatctgaggaaccggtatgccaagagaactggctgtcacaacaatttgcacagattcataaagaatataaaacataatagccaagtcacgaattgatccctctgtattcagcagctgatcaaaaaagtggcatacagagatcagagccagcgtgactaattttttgacaagccgggcaaatatcttcttaaacgacagtttgtgaataatcgtttccttcaaagtcgtactgataaattcaattgccataagagagagcaaaatcagaaatgaatactgaaaacctccaaagaaaaaacccgctgctgaaacgctgactgctattaacgaaaagatgccaaagtctctatccatttatcccaacatcctttcacagaaacggccttacgatattctatggaaaacaagccgaacggattggatttttcagaaaaatggactggttgtcgcctatttttcagatacaaaaagaaaagccggacgtcttttttaagacatccggccgttctatttttgaacttaacctaggtaagcttttagcatccagttatgtttttcaatattttgatggatcgcaagaagcatgtcccctgttgtttcgtcaccgacttcatcagctaaatccatgccgtttttcagctcttccgcgatgactgtgaaatcatcatatacgctttgaaccatttgttcagctgtttcatttccagccgcttctttgacagaagccgtttctaaggattccttcattgttgcaatcggttttccgttcagcgccaaaagacgttctgctaagtcatcaatataagttgctgtttcgttgtacagctcctcaaacttttcatgaagagtgaagaaatcttttcctttcacataccagtgataattatgtagtttcacatacatgaccgtccagttggctacttgtttgttcactgcttgaatcaattgttctgacatggtatctcctccttgttatatgactatgtatacccttaatatcgtacgctaaaacctcttttttacccttatctgtcacgatttcttctattatgctacaattgttaaaaaacgggaggtggaatgtcatgacgcttctcattacgataagtattttgattgtgctggctgttttgattgtaaccatttggacgactgtaaaagcctataatgtaaagcataccattgatccaccacaagaaaatcactctgattcacacaatcaatgatgatgtgaatgctcctcttctgactgattgctggcagcatcggcgtctccgacttggacttttaaggtcggcatgctatgctgtttttttgctgtgacatgggattggacagtgtatacaccatcttccttaaacgtcgtttccaatcggtatacgcctttttcttgtttcgccttaaacatttggctggcgtctttttccccttctttccatacttcaaactctacttcatcggcatccgtcacagcttcatcaccatatgatatggctgcttcataagcagcgctttctccgggatttactttttcaggcccggtcagcttgacatccaaaacctcggggtctcagctgtatttgctttgctttcaccagatccgcatccattaagcaaaaaagcagaaaaaagcagaacaaccaacatctttttcatgccatcaccctttcatcgtttacctaaatagtagcaaacgcttacagcaaatggtacacaaaatatgagacgtcacaaaaaagacctttttgcttaagcgcaaaaaggacctttctattttagccaaatacttttagcaattcttctttatcctgtgaaagccagaaacgcattaaacgtttagcaccttccagatcatgaagcttcgcttggccgcactgcttttcattcgcagctggtatttctgtaatctctaccgcttccttcattgtgtcttcaagcagatcaacgatttccgctgatgtcggctctccgctcacaactagataatagcctgtctggcagcccattggagaaatatcaatgatatcaaaatgatcgtatttctcagcgtgagaacgaatcgtaaacgcgagcaaatgctcaagtgtgtgaatggtgtcaggcttcatcgcctgtttatttggctggcaaaaacgaatgtcaaatttattgacaacgccgtctgttcctactttatgcacgccgcaatgtcttacatatggagcaacaaccgcattatgatcaagctcaaaactttctactgaaggcataatggcactctcccctttttaaaatgtaatttcattataacatacttttccgataagaattattgattaacttttcaatctgtgttttttttcttatacttgcatcagaaaggttgctgaagaaatatgaaaaccctattcatcgctttgatcagaggatatcaaaaattcatctcacccctgacgccgccaacatgccgcttttatccgacctgttcccaatatggaatcgaagcgattaaaacgcacggcgctttaaaaggcggatggctgacaatcaaacggattttgaaatgccacccgttccatccgggaggagtcgatcccgttcctgaaaaaaaacaaaaacattaattgttatagccgtttacgataagatccagttttcctgttttaggatcaatgactaagccatggaccggaacgttttccgggaacagcgggtgatgtttaataacgtctacgctgtctttcacactcgcttccactgaatcaaagcttttaaaccattgatcaaagtctacaccggagtactttattgtttcgatgcgttcttccggaatccctcttgctttgattttttcaagcatgcttttgctgctgattttgctcatgccgcaatcgtgatgcccgatcacacacacctcatctgcattcagctcgtacactgcgacgagtatacttctcatgatgcttccgaatgggtgtgtcacaagcgcaccggcacttttaatgattttcacatcaccatttcgcaaattcatcgcatgcggcagcagttcaaccagacgagtgtccatgcaagaaagaatcgccatttttttatctggaaattttgatgtttgatacttttcatactctctttgttcagtaaatgtcttgttaaattcaagaatatcatttagaagactcatgttcgttgtccctttctattctttttactcttcaatatatcacaacccttgtttattcgtcataataaaaaaagacaaaccctctggtctgccttatttccccatgttatagcgttttttgaactgctcaactcgtccgcctttttcattgaatttctggcggcctgtataaaacggatgcgtgtcagaacttacctctactttaatgacaggatatgtgtttccgtcttcccactctgctgtttcattagatgttttcgtagaggtgctgagaaaacggtagccgctgttgacatcctgaaatatcactttgtggttcttcggatgaattccttctctcatgtgtatctcctttcaataaatcgtaataattacgttttattttataaccttacaaacgttttgtcaatcttcttatatccttccctctgttttcgcatcgtaaacctcatggcatttaagaataggaagaataatctaaccgaggaagcaaataataaacccaaaatacatacagaacgtctttttagaaaggtggtttacgattgtggatgatttagttttggccagaagcctctttggcacgacaatgggctttcatatcattttcgcaacgcttggagtcggtctcccgctcatgattttagtggcggaattgatctatcaaaaaacgaaagatgaccattatgcgatcatggcgaaaagatggacgaaagcacaagccgttttgctgggggtcgccataccgaccggaacgatcgcgggcactcagctcgcgcttttatggccgggatttatggaagtcatcggccgggtgatgtccctgccatttcaaattgaaatctatgctttttttgttgaagcccttttcatgtcgatttatgtatacgctgcagaccgtttgtcacctgtaatgaggattgttgctgttttctttgtgttagtcggggcagcagcatccgctgttctgattacgaatgttcacgcttttgaaggtacgcccgccggttttaaaatcttaaacggaaaaattacagatgttgacccgtgggctgcgttttttaatcctagcttttttatcactgccggccatgtcgtgctgtccgcgtttatgaccggtgcgtttatcgtggcttctgttgcggcgtataaaatgatccggacgaggaaaaaggaaaaggtctatcgctttcaccggaaagcccttttgctcgcactgacgatcggcggtattttttcattgctgaccgcattgaacggacacgaatctgcacagatgctgtacgaataccagcccgaaaaattagccggtgcggaaggcctgtttgaaacaagatcccacgccccgctcgctatcggcggttttaccgacccgaatgaagaaaaagtaaaatgggcaatcgagattccatgggctttaagctttttggcagcgaaccgttttgacactgttgtaaaaggattaaatgcatttccgagagatgaatggccgccgcttttcattcacacgctgtttaatgcgatggtcggtgtaggcatgctgcttattctttattctattattggtgtggtctggagaaaggtgctcaagaaagaccgtttcccaacgtggcttttggtcattttcatgacagcaggcccttttagtctcatcggcattgaattcggctggattttcgcatgtacggggaggcagccttgggtcatctatcatttgctgaaaacgtcagatgtcgtaacaacgactggctcgatcggggtgctgttcttatttttcacatttgtttatgccgtgttaggcgcagctgtcgtctacgtgctgctgtattatttccgcaagcacccggttgacgaagatttaaatacagcggagtcgtaatggctccgcaaacaggaaaccaaatggaaggaagatcgtacaaatggagatttcaactgacgctctgatcgccatctcaattatctggggctttgtgtttatttacgccgtcatggcgacaatggattttggagcgggattttggtctatgatctatttaaacaaggagcatatgaaggccaccgatattgcgaatcgctttttgtccccgacttgggaggtcacaaatgtctttattgtggccatcgtcgtggcgcttttcagttttttccccggcgcgacatttgtgctcggcaccgttttattaattcccggaagcatgattttgctgcttttagcgattcgaagcggatttcttgttttttcaaatacagcaaaggagcggaaaacgctaagatatatttccggcatctccggctttatcattcctgctattttaattttggtgcttcctgtgacacacggagggtttatagaaaaaacggatggaatctataacttaaatatgtctaaaatcttttcaagccccaacgcctattcatttatcgggtttgcgattttaagcaccttatttttgtcctcgctgctgcttgcagatgtttcaaatgtggcagaggaacaggatgcgtaccgagcctacagaaaaagcgccctgattaccggcccgatttcactgttgtttgctgtatgcattatggtaactatgcggaatgaagcaaactggctgtacagcggaatgatgaatgatttttcttggattattgcatcgttcattacatttgtcattgctggaatcgctctttttctgcctaacaaaagctttggtcaaaacatcggaaaaccgcgtctcgcacttgttgcgattgggatacagtattttctcgcaagctacgcgtacgggcgggcgcatcttccgtatatgatttatcccgatgtgacagtcatgtcaggcttcacagagccagcaacgttcagagcgctgtttgcaacgtatatcgttgcatttatcattctatttccgggcttctttttcttctggaaaatgtttatgcgagataaacgctatatccgccaggaggaatagagggcaagccagccggctatactaatccagaacctttataaggaggggatggcatggagcagaaaattctatgtgaggtcaacaactgttcttattggggcaaaggtaacaaatgcaccgctgatgccatttatgttgtcagccatactggtgaaacggctgaaaacagccgggaaacagactgcaaaacgtttaagccgcatgatttgtaattaaaagaaagagctgcatcagccagctctttctttttgcatgttgagtgttctcagctttttagttatgaccccgtttgcaggtgaaaacaaaaaggcgcttgcataacatacacctgtcatggccgccatcgctcctgaaatcgaaacattaagccacgttgcgaagaaatagcccatgaccgccgacagcccaccaatcaacgcgctgagaatcagcatataaagaagccggtctgtcagcaaatgtgccgcagcaggcggaacaatcagcatggccacaaccaatacagcacccaccgaatcaaaggaagcaacagtcgtcagggacagcatgcccatttgcacgtaatgaatgagcaaaaccggtattcccaaggctaaggccatttgaggatcaaacgaagcgattttaaactccttatagcacacactgatcaacactacgtttaaaaccagaacagatgccagcatccaaaacgctttcggcccaatatcaaccccgaataccgtcatcgtattccacggcacaaaagcgatttctcccattaacgagtgctcaatatcgagatggacattcgctccatacacagaaagcaatataaccccgattgcaaataaggatgtaaacacaactcctatggcagcatctgattgaacccccttgctatgaagaagctgaaccaagaaagccgttaacagaccggttgcggctgcgccgataaacatagaaatcccgtcgagacttcccgtcactagaaaagcgccgacaatgccaagcaacactgtatgactgattgcgtcggccagcatcgccatgcttctcagcacaagaaatgtgccgatcaatccgcagcttacaccgactaatacacccgtagctataatccatgcttcaaaactcatttgcgatctgtcccttctcggcatcatgagacgcttttcgacgctcaggcatccgtccatacagctttaagagtaaataaagccgctctctcgtttctctcggtaaacggtccgggtcaaaatagtcctgatcggattctatattggcaagttccatttcatgcatgagaaacacttcatacatccgctgcttcaaagctgtgtgatagcctttttctatccctttgcttgtgaattgccaaatcccattctcgatacgctcaatgcacctctcttgttccaagtcatttaatgccttaaggcataatgaaagggataggcgtcttttctttcttacacattcaacagttacacaaagattattcttttcatactgttcataaatcgccaaaagcacttgctccctgcttgttctgcgccgcagcctcatcagccttatggctttagcagccaatccccgcttaggcgcgcaaatcattgaaaaaagaaagagcagcgttgcagataagatcattaatggccctgtcgccattcccttcatcgtggtgctaagcagggttccggccactccgctgaccccgcctgtaatcccggcaatgatgatcatcctggttaatcgttcggtccaatatctcgcggttatggcaggtgtaatcagcattgccgccattaatatcacaccaacagtctgaagcccaatgacgacagcacagacaatcagacaagccaaaagcccgtttaaaaaacgcaccgggattcctaatccctttgcaaacgcgagatcaaaagtaatcaatgtaaattccttaaagaaaacaatacataggagcagtagaacagcggatatccctgcaataaggatgatatcctgcctgaccaatgaagcagcctggccgaataaaaaagaatcaagcccgctttggcttcccaccccctgttgctgaatatatgtcagcagaatgatcccgacgccaaaaaacacagaaagaacaatcccgatcgccgagtcctcctttgtttttgaaagccgaggaatcagctgaatacaaaacgttccgagcagtccggcgagcgctgcccccagcaaaaagaaaggcagtgatttttgcccggtgaacagaaaagcgagacacactcccggcagagctgaatgggccatcgcatcgccgattaaactttgctttctcagcagcacaaagctgcccaaaacaccgcttgccgtcccgagcaaaagcgtaccggccagcacccactgtgtattcggatgctggagctgcagccacaaactttcaaacattacgttcactccttatgtccttctgccagcactttatcttttaaaaacgtaagccttcctccatatgttttttgcaggttttcgatcgtaaaaacgttttctgccggtccgaaagcgatttttcttaaatgaagcagtaagatccaatcgaaataatcctcggcggtctgcaggtcatgatggacgacaagcacggtttttcctttttctttgagttctgccaacagcgtcataatcgcgcgctccgtcgctgcatcgacacctgcaaacggttcatccataaaataaatgtcagcgttctggcagagtgcccgggcaagaaacacccgctgctgctgtccgcctgacagctggctgatttgcctctttgcataatcaagcatcccgacttttgttaatgcggccttcgccatctccacatccgctttctttggcctctttaataaaccgattctcccgtatcttcccattaggacgacatcgagcgcgcttgtggggaaatcccagtcaaccgagccgcgctgcggaacatatccgattctggtccgctgatccttatagtctttgccgtaaatagagatgtctccggaagctcggggcacaagaccgagaatcgttttgatcaaggttgattttcccgcgccgtttgggccaataatgccaatgagttttccttccggcacctgcagtgaaatgtcctgcagtacaggctttttatgataagcaaccgtcacattatcaagctcaacagggaacatatcctccacctcttttctttatttaagcgctttagtaatcgtgttgatattgtggcggaacattccttcgtatgtgccttcttttgtgcccttttcacccatggcatccgaataaagctgaccgccgattgtgactgtatggcctttttctttagcgccttccaccactgcattgattgatttttcagatacactgctttctacgaacacagcttttatttgtttgtctgtcagaagatcaaccagctcctgaacatcccttaatccatagtccgaatctgtgctgagtccctgcaggccttttaccttaaatccatactcattcccaaagtacgcaaacgcatcatgagcagtcacaagcacacggcttttctccggaatatgtgcgatctccttacgcgaccacttatctaaatattgcaaatcttctttgtactctttggcatttttccgaaaggcatctgcgtgctgaggcattgctttgctgaattgcgcttcaatttcatccaccgcatagatccataacggaatgctgaaccagacgtggggatcaaacgtcttgccttcccccgcgggaataagcttatttttcggaatggcctcagctactgccgccgattgtttttgttcgccgattttttggaggacatcctccattttcccttccaaatgcaacccgctgtacagaacaacatcggcagacattaattttttcgtgtcaccttgggaagctttgtaaaggtgcggatcaacccccggtcccattaaagaggtgacttttacatgcttacctccgatgttttctgctgcatcggcaatttgagatgttgtcgctgtcacttgtaattgctgatcagcgctttttccggctgaatccgttccgcatcccgttaaagcaaaggtcgcaaaaagtactgctgccatcagccctcgtctcatatttctcctcctctttgccatcaatgtccgattgttttatcttatgttgtcagttcttagacatatgacattaaattagccaaaagcatgttttatttacacaggacaaaaagtttcctttgtgcaaaattatcgcgtttggccatttttgtcaagctgatttacataaaaaaaccggctgggtcagcagccggtccaaacgagaagggatgtattcaacgaacacttttactgtaacagcacagtgtcatttattcaaaatagcaaaatgcttttttcttaaccatgctgtgtgaaaacatccattttggtcacatattttcgcataatgtcttggtttacctcaacccctaaaccaggctgttttgacacagaaataaatccattatcaatacgaatatcaggggttacaatatcttcatcccaatagcgtgaggatgaagatatatcgccaggtattgtgaattgaggcagtgaagcaagcgccacgttctgcgctcttgatatgcctgtttccagcattcctccgcaccaaacctgcatatgatgctctttgcataaatcatgaatttttaaggcttctgttaagccgccgacacgagaaggttttatattaataattttgcagcttcctagctcaatcgcccgtctcgcatcatcaactgaacaaatgctctcatcaaggcaaatggccgttttcaaatgtttctgcaagtggcggtggtcaacgatatcgtcagcttggagcggctgctcaatcatcattaaatgatagtcatcaagctccttcaaacggctgatatccttcagctcataggatgaattggcatcagccatgagcgggatgtttgggaatcggctgcggatggccttgaccaattccacatcctgcccaggctgaattttaatttttattctttgataaccttctttttgatagctctcaatttccttcagcatatcgtcaagaggcgccaggccgactaccaccccggcagggactttatctcttgttccgcccaatgcctcagcaagggatacgcccttctttttggaatagatatcccatacagccgattcaagtcccgcttttgccattcggtttcctttataccgcgccaggctgtccggcacttctgaagggtgattgaattcacggccgacgacatttgggataaaaaaatcttttagcatatgcaaacatgttccaatggtttcctcggtgtaccaaggcgaagagaaagcggaaacttctccccagcctgtgacacctgatgtatcaatggcttccacgatcagaaatttacgctcttgaagcgtttcgatactgtttttaaacggtttttttaagttcatgctcaaatggtaaagcgtgattttttctatttcgatcatagcagttctcctttacgcgcatccttcagctgatttcgcaagagcttattagacgcattgcgcggcaggcggtcaagcacatagaattttgccggaattttatacttcgccaagcgttctttgcagtagtcagtcaattctcctgcgctcacaggcttgtgaaggacaagataggcgtgaggcactttcccccattttttgtcctcagcccctgaaaccccggcttcggccacagcggggtgtgaaagcagcactgactccacttcggccggataaatgttttctccgccagaaatgatcagatctgaacgtctgtctaatacatataaaaagccttcattgtccaaataaccaagatcacctgttttcagccagccattttgaaaggaggcttcgtttgcgctctcccggttaaaatagcttttcatgacattcgggcctttgaccatgatttcaccgtgttcatacggttcacatacctgtccgtcccgctctattttgatttcacatgaaaacagcggtttccccgcagatccgagcttttccatactaaattccggcgacagggtaacaatttgcgagcatgtttctgtcattccatatgactgaaagacagggaatcctttctcacggcattcctcaagcaatggcagcggtgcagggccgccgccgagaagaatgcatctgatggattcagggcagcggcttgtttcttccaaaagactggccagcatagtctgcaccgcagatatcattgtcacttcatgcctgttgatagaatccagcacatcacttacggaaaaacgctggtgaagcacgacagtcattccatagatgacagatttaaataatgcggacaagccgctgatatgaaagagcggcaatgcgataagccagcggtcttgttctgttatacccaaattaagcgcggacgacaccgcactgaaatagtggtttccgaacgtttgctgaactcccttgggctttcctgtcgtacccgacgtatacatcagcgttgccgttgcatccatttgcatataagcttggatctcaatttcctgtgctgcttctttcatcaattcatccacatcaatcgtttgaacgatgtgttcatactctttcttgttaaagcttgaatctgtcagtaaaaagccggatccggaatcctccagctgaaacagcctttcatgtgttgacagcttcgtattcaaaagcaccgccttaacaccaagcaaaaaacaagcgtgaacggcgtataccatttctgcacggttttggagcaaaatagccgcagtatcccctttccgaaccgaatgagcggcaagctgtgccgccattcgcttagacgcggcaaataattctgcaaatgtcacggtttgatctctatagatgagagcgattctctcaggtgtcagctgtgcccgctgcatgagccagttaggctgttctgtcagcatgtcatcatctccgaggtaaaatgtctgtattgaaaagaaaacagcttggaccgcaaagtctcaagctgttggtttactagtattgctgatcacgggaaacgagggaactgtccgaaatcaggtttgcgtttttccttaaaggaatcacggccttcttttgcttcatctgttgtgtagtaaagaagggtagcatcccctgcaaactgctgaattccagcaagtccgtctgtgtccgcgttaaacgcagctttaagaaagcgcagtgcggtcgggcttttttcaagcatttcttcacaccatttaatcgtttcttcttcaagctgttccaaaggaacgactgtgttgacaagacccatgtccagtgcttcctgtgcgttgtactgacggcataggtaccagatttcacgtgcttttttatgtcctacaattcgagccaggtagccagaaccgtaacctgcatcgaagcttcccactttagggcctgtttgtccaaaaattgcgttgtccgcagcaattgtcaagtcacatacgatgtgaagcacatggcctccgccgatcgcatatccggacaccatcgcaacaaccggtttcgggatgacgcggattaaacgctgaagatccaatacgttaagacgcgggatctggtcgtctcctacatatccaccgtggccgcgcactttttggtctccgccagaacaaaatgccttgtcccctgcaccggcaagcacgataaccccaacgttttggtcgtctcttgcgtcagcaaacgcatcaatcatttcagcaaccgttttaggggtaaacgcattatgtacctcaggtcggttgattgttatttttgcaatgccattatacgtttcatacaatatctcatcgtatgtccgttttgttttccattcagccatatgatgacctccttttattctctatgtgaatgagtcagatgcttgtcaaaaactcactcactattttaccaaacaatcgcggctgttccacatggaccgtatgtcctgcttttggaacaatctctattctactagaaggaagcatcttatgcacctcttgattgatggcgcaaaatttttcgtcccactccccgcagataagaagcacaggaacatctatttcctctacacggctccacaaggaaggctgtgaaccggtgcccatgccggttaaactattcgcaagcccaatcttattgttccgcagacggcccgatcgtatcctgtgccgaatatcttcagccagcctctgctgagatgaaaacaaagggatattctcccaatacgcaacaaacgctttgagcccgtctcgtaaaataaaatcagcaagcttccggtcccgcatgattcgttcccgccgttccccaagtgttttgagccccggcgtcgtgctttcaagcacaagtgccgatacccgctcgggatatgtcatcgcgaaagagtaagcaagccttcctcccatagaatacccaatcaatttcactttgtgaagttttaattgatcaaaaatctcggcaaggtcagaaacttgccggcttgtgctgtatcttttcccattcagcggggcatcggtttccccatgccctaaacaatcaattttgatcaaacgggaatcaggcagcatttcatcaagaaaagtccatgaatgtctgctgccggtaaacccgtgcagacagacgacggcttcggaagcattcggtccctcgtctgccactgcatatcggacaccatctgataccgttatgtttacagttcccattgttttttcacttcccgcacagcctcattcagcatatcgcgatgaagctggactcttgattggcgatccgttttgatttcaatcaaatggagtccgggcttgtctgcctgcggcgcgtaagctgttttgaattcatcccaagaagccgggcatgaatacgttccgccgtaaagtgcagccgcatgcttgaaatcgagccctgtcggtgtgccgaacaaatcttcaaagtgtgtcttctcagaagcctgcggcaaaaaggagaaaatccctcctccgtcattattgacaagaatcacagtaagaggaatacccagctttttggccgccagcaggccgtttaaatcgtgataaaaagataaatctccaatcacaagggtaacaggcgcttttgttccttcacatacccccatggcagaggagacgacaccgtctatcccgtttgctccccggtttgaataaatccggaaagggcggtcctgcttttcgaaaaacgtatcaacatccctgatcggcatgctgtttcccacaaacagcgagctgttttcaggcacaagatgctgaaggattcgatagagattgccttcaaacgaaacatcttcactgctgattgtttgcagatgctcgcggaaccgcccattgacaaactgccacttttccagccactctgaggatctggcagcagcagtaaggcctcccatgatctcctcagcaaaaacagacgcattacaatgaatcatatgcgcgcttgcctgtgtcgggtctctccaccctccatcctcgtcaatcactatttgctgaatcgcaggatcatccttaagccataagaaaaccggttttgaaacaggcatcggtccaaaccgaatgacaacatcaggacgaagtttccgcttcagctcatcatcttttaaaaacgaatcatacgcatcaataacagtgcttttatcatgaacaccattccgcagattagacagcggatccgctaaaattggatactgaagcgcttttgacagcgcaataatgttttccttatccgcatcactatggagctctccgcagacgatcattcctttttcagcctctgcgagcatctcagccacatcagacagggactctcggtcaacagactgcgtacccgttttcacagacacatgacggcctgttctcattcttccaaacggctcatctgaaagatccggcatcagcggttcgcgcagcggcacattcacatggacaggccccatcgggcgcttttgtgcttctccggcagcgcggcttgccagcgttcggatgtatctcagcatttgcggagactcttcaggaagagcagagtctgtgaaaaacttaacaaagttaccgaataagaagtgctgattaatagcctgtggtgcgcctacttcgcgcagctcatgaggccgatcagcagttaacacaataataggcacccttgaataatgggcttcaaccacagccggataaaagttggccgcggctgttccagatgtacagatcaatagtacgggacgctgcttcgcttttgccaaacctaaggcaaaaaatccggcagatctttcatcaatttggacatggacgctgatatcgggatgcgcagcacaaagaacagccagcggtgtagatcttgagcccggacaaacgacggcgtccgtaattccggaaagggcgaattcatcaataaaacttccgatgtaatgagtaatcgggttgactgtcaacgcctctcacctcctaatgcagagatcatcggcttcaatttaatctgtgtttcttcatattccgagattggttccgagtcttccacaataccgcacccggcaaacagccttgcagtgcttccttcgatcagccctgaacgaatggctaccgcgaattccccgttatcctggctgtcaatccagccgataggggcagcataccagccgcgagacatcggttcaatctctctgatcacgtcaacagctttttcctgaggtgctccccgagcgccggagtgggatgcagcttctcaattaagtcaaaaattgaagcagactcgcgcagctgtccgacaatcggcgtaaacaggtgctgaacgctttttgttttgtacaaaacaggtccatcaggcttttcaacctctgaacagcttgatacaaaagcattatgaatcatacctaccacaatatcatgctcaagcaggtttttctcatcgtttaataattcaaggcctatccggcggtcgtcttcttcattcacgcctcgtttaatggagcctgccagacaggaagacatgacagtgccgccgtctcttttgatcagtctttccggagacgcgccgacaaaagttttgccttcttgttcaattgcaaaaacatagcttgtctgctgatcgtccacaagcgttttaagcaccggttcaatttggattggaccgtcaaacgtgagcagcagctctcgggcaagaacaaccttatcatattgtttctctttaatttggcttgtggccgtttcgattgctttcagccaatcatccttatccagctcttcggctgctgcaatcacagcctgatcttcttgcttgaaatcgggaaccataaattccgctgcaaaagcttttaagcctcctaaaacagcttctgcatcttctcctccgcttacccatctgttaactgttaagaacgggccttcagcagtcatcgtcagcataagcgcaggcacaaagaaatccccttccgagaaatggtcccattgtgaacctctttcttcgcaagggtcaaaagaaaatcctccgaataacacaggtcccactgcagaatgctgcagcttttcttcttcataaatatgaaaagccgtctttttaaagcgctcccattgttcaaaaacctcacgataccgctcgctgtttttttgatttgtctggaaaaccgcttctttgccaagaccgactattgtcaattcactttcaggatctgaccaaaaaaatcgattgcctgtatatttttttgctccgtaattgaaaaatgatagagggtcaagagactcgatttgtctcgaatagcttattaagacagcatggttgacttctttggctttatgtaatgcatgtagaacttcctttcggaacgtacgctgcaccgttgtcaccatgagacattcctccataatccttaaaatgcttttaataccatacacctgtgtctcctttgtgtcaaacacagatcatgcagtccaaatggcctgccttacctattataaacctaatttcagaaatgaaaaagaaacaaagcttaaatttctttctccactgatagcaaaggttgtatccgcttaccataaaaggaaaacctcctatattcctccacccgccatttatgaaagttctcaggcgatctgttcatactaaaggtatgcatcacagagaaacgaggcgatcatattgcttacaaaagaacagcttcagcatttaaaaaatgaactggaacaaacgaaaaaagatatcttaaaccgtttcaaagacaatgatcattttcagcttaactcagcatttccttatgattcgtggggtgagctttcggcatacgacaaccatcccggcgatcaggcgacagaactttacgagcgtgagaaagacatcgctctagacttgcatgagcgagagcaccttcgggacattgagcattcattaaaggcgatagaaaacggtacgtatggcatttgtgaagtcagcggaaaggaaatccctttcgaacgacttgaagcgcttccgactgccacaactctcgcggagtattcgtcacaggacgtggtttccaaagaccgtccgattgaagaagaaacaccattcgggcaatttgaatttgatgatgatgaagaaatcagagcgccatatgacagtgaggattcctatcaggatgtcgaaaaatatggtaactcacaaacgccgcaggatatggaaaaccctccgctcagctatgatgatatgacgatgaatgccgaagagaatatcggcaatacggagtcttacgaaaatttcatcgctacagatatcactggaaaagaaattaccgtttatcaaagcagagcccatgagcgctatgaagaagaacttgacgaagagggaatcatgaccacattcggcgatctccacgctgattgaaccccgattattgggggttcttttccgttttcagcatatcgtaaatcagcttcagataatccttttgcaggccgatgtcataccgctcgccctctagcaatttcccgtatacggtacatgcccgagcgaagcttttatcgcatccgttacctgcacttctcctccgctatcagcttctaatgcctccagctcattaaaaatatccggtgtgaaaatataacgccctgctgcggcaaaatgagacggagggttttgtttaggcttttccacaatatcctgtatgcgataaagccctttttcaacaggctccccttttatcaccccgtaatgatgtaaatcctccgtttttgtttcttttaagccgatcacactggactgatatttcgtatacgcttcaatcagctgccccaaagccggctgattggcggaaaaaatcagatcatcaggcaaaacgacggcaaaaggctctttgcctgcaaattgctttccgaaagaaatggcgtcgccaagaccctttgcataaggctggcgcacatagtgaatccgtatatccggaatgggatgctcactaagcaaatgcagtttattcttagaggccaaaaaagcctcaagtgccaaagaggaatcaaaatagtcgacaatcagatttttatggctcgatacaaccatcaaaatgtcctcaatgcctgactcctttaattcttcaacaagataatgaatcacaggcttagatcctaccggaaacatttctttcggaatcaccttcgtcaccggcagatttctcgtgccgaatccgcctgcaggaatgatcgctttttttatcatggtattttcccctcagctcatgtttattacatgatattccaagagcgcatcccgatgtttgtacatctgaaattaggcggaagcaactgggcagaaagcggaatcacgaaccagcccttttttaataggatattgatatatgaccagtaatcttgtaaaggagctcaggtgatgaaaatttgtgtggttggcgccgggtatgtcggtttaaccctatcagcggcactggcatccatcggacatgacatgatatgcacagacaaagacgtcaaaaaaatcgggcagctgaaaaaaggagtcattcccttttacgagcctgggctttcagatgcaatacttcgttgcggcaatctctcgttttcttctgaagtgaaatcgagcatggaggaatgtcccgttatttttatcgcagtcggaactccgccgcgttcggacggatcagctgatacgaaagccctgcagtccgtcatcggtgatttaagcgaggcgatccgatcgtataaaaccattattacgaaaagcactgttccgcccgggacaaatgaaaacatagcaaaacagctgattgcctccggagtgtctaaaaacctctttaatatcgtatccaatccggagtttctgcgggaaggcaatgccttatatgacatgctgcatcctgacaaaacagtcatcggtgttcaggaagaagatcacgtatcggcagccatcgtcaaatccatttacaaacacattgataccccttttatcgttacaagcttagcgggagcagagctgatcaaatatgccaacaatttctttttagcggccaaaatttcgttcattaacgaaatggcccgcatatgtgaagcctatcaatcagatatctcagatatttcccgcgctatcggtctagacccaaggatcgggaagcactttttgcaggcaggcatcggatacggaggctcttgttttccaaaggatctgcaggcgctgcaatttgctgcccaggaaaaaaacacggagaccttcctgctccgggccgtgcagcacattaatgacacccagcttggcctgtatatcaaaaaaatacagtcattcttcgaaacacttcaaggcaagaaagcggctgtactcggcatttccttcaaaccgaatactgatgacatccggaattctcaggctgtcagactgatggaaaggctggcggagctgggatgtgatgttcatgcatatgatcctgaagctgtacttccagaacatttgcggcaacatgtaactcagcattctcaagcttttgatgcgatcgaagaaagcgactttttatttttggcgacagaatggtctgagtttttagcgtttgattggaaaaaggctgcagatatcatgaaagggcgtcttgtgattgacgggcgcaacgtactaaaaaaagaactgatcgaggcttgcggcctgatctgtacgggagttggccgtccatgaaaatactcgtcacgggagcagcgggctttatcggctcccacctctgcgaagaattactaaaagataagaaacataacgttattggaatcgatgactttatcggtcctactccattttccttgaaattaaaaaaccttaaaaacctgctgccggaaaagcgatttacgttcataaaggaaaatctgctgacagcggatcttgctcccttactggaaggagtggacgtcatctttcatttggcggccataccgggtgtccggtcaagctggggcaatcattttcacccatatgccgcacataatatccaagcgctccaaaggctcctcgaggcgtgcagggaacattctattcaaacgttcgtctttgcatccacctcttccgtctatggcgaaaaacaaggaaaagtcagcgaaaacacgtcgctttctcctttatctccgtacggggtaacaaagcttacgggagaaaagctttgccatgtgtatcaacagagctttggcattccaattgtgattctccgtttttttaccgtatacgggccaagacagcggccggatatggcttttcaccggctcattaagcagcaccttcagcaaaagccgcttaccatcttcggtgatgggcagcagtcaagagatttcacttatatcagcgactgtgtcaaaggcatcaccgctgttcttgggaaaccccatcttattggtgaaacagtaaatatcggcggcgcagagcgtgcctcagtcttaaaggttgtctcccttattgaggatatttccggcagaaaagcaacactgcacttttcggacaaaatagcaggggaaccgagcaacacgtgggcggatatttcaaaagcaaaacagctcttgcattataatcccgccacatccttaaaggatggcttgaccaacgaaatcgcctatttatcgtcgctgtatcagggggaataaaaatgaagcttgcctttatctgtacagaaaagctgccggcgcccgcagtacgcggcggcgctattcaaatgatgattgacggtgtcacgccctatttcagcagcaggtacaacctgaccattttttcaatagaagatccatcgctcccaaaaagagaaacaaaagacggcgtacattatatccatctgccaaaagaacattaccgcgaggcggtagccgaagagctgcgagcctcttcctttgacctcattcatgtgttcaacaggcctttaaatgtctctttatataaaaaagcctcaccaaacagcaagatcgttctgagcctgcataacgaaatgttttctgagaaaaagatgaccttcgcgcaaggaaaagaagtactcgacaatgtctccataatcaccactgtgagcgaatttattaaacaaaccgtcattgaacgtttccctgaagccgaggacatcacaaaagttgtgtactccggcgttgatttaaactcttatccgcctgtctggacgatgaaaggctcggctgtcagaaaaacataccggaaaaaatacggtattgaagataaaaaagttattttattcgccggccgcttaagcccgacaaaaggacctcaccttctcattcacagcatgagacggattttgcagcagcaccctgatgctgtactggtcatagcaggcgggaagtggttcagcgatgacagcgaaaaccaatatgtaacctatctgcgtacgctggcgctgccatacagagaccacataatttttacaaaattcattcccgctgacgacatcccaaacctttttctgatggcagatgtatttgtgtgcagctctcagtggaacgaacccctcgcccgtgtgaattatgaagcaatggcggccggcacgcccttaattaccacaaaccggggcggaaacggagaagtcgtaaaagacgaagtcaccggccttgtcatcgacagatacaacaaaccttcttcatttgcaaaagcaattgacagagcctttacagatcaagaattaatgagcaaaatgacaaaaaacgcccgacagcatgtagaagctttatttacctttacccatgcggccaaaaggctcaatactgtttaccaatccgttctcactccgaaaaacaaacaatttccgccgccttttctgacgcaaaattttgatttatcatctatcaatcagctttttgtgaaagcaaaaacataaaacctacagctcgtgttgcaaaacgggctgtttttttgctgcagagaacatgaaaaaaggcataaatatgactttatgccttgcgctttacggtttgagaaaaccatggagctggtttagattcacttggaagaatgatgatttccactttagcttcttccgctaagtctggttcttcatcttcctcctcttcttctacatatgggggcgctgagcgtttcgaatcacgttcctcctcaggctctagaatggtttcgaatttcgtttcttcttcatcatcgacgattttgtgatctgtttccttttccttcgtttcttcttgatattctttcggtgcattgatgtgagggagctctcgaatgctgcccacatctaaatgcttctcctcttcttccttctcagctgacattgagtcatgagcctgccaccccatcggtccaggcggtgtaaatacgaattggtcgagatccagtttagaaatagaggctttttgtctcgatgacctcatgtcaattcgcctcccgatacgcttttatctttttatacagttccggcagtttatccaaaaacgaatctttagattcttcaacagaaatcatgttttgcagcgcccagttatacttctcatctgaccacgttttcttttgcttcaaataatatttgtgcccgattgcacagaacaaatgcggaaacgcgagatcaatccaaagtacctcgtactgtttttctgtgagcggatacactgcgtcgtaggacgcaagcagtgcaaccatgaaatcagtatcccaaacagaaagcttaaccatcactttattcagcagaatacgaaggtctcttgacggcaaatcgtaggtaatcgagtgaagctcctttaaaaaaggctccccttcgatctcagtcaaacgtgccaatgtaaaatcctgaaaacagaatccgccatgctcgagcgtctcttttgtccaggtttcgtattctgagtcatcaagcgctctgagagcttcttttcctcttgccagcattttatcagcatgttttaagaaagtttgcgaaaatacgtcatcaggataggatgctgcgatctgcatattcccctccagttcctgcagcttccaacggtacaatttgtgccattttcccagcctgcttctcttcttgctttcatctgtgcaaacatatccttttgaggcatgatgaaaatggccggcaaatgacatgacttttttcatttgctctgcatcatagtaaatcatttcttttcctgtcactttgtcatataagctgtaagaaacctgatccgtgcccaagcagctaccgccattttttgtttgatgaatcggcgctatcggcagccctttctcttgtaaatgggcgtgtgcctgagtgataaaaagcatccgctccggtttcatttgcgcttcttttagcagctttgggccatgatcagtttcgacttcccagattttgcgcccgcttttgttcgatttcagcgccacatggtcgatatgaaacggataataactgagaatttcggacacaatctgttcttcatgctctttttggtacactctgttcaccccttctatctgttcttttcatagacgctgagcagattttcagccaccctctgccagccaaaattgctttctgcctcacggcggctgtatttcccaagccgttcccgcttttccgagctgctcagcaaatcattgatacgttcggcatattgtttaggattttcaaagtcatgaatgatgtagccgtttttcccttcctctatgacctctggattgcctccccgattgcttgtaataataggaagtcccgcagccatcgcttcataatgcacccttgctaaaggctcctgccattgcgaagagcatacaaatacatctgacatggtataaaggcgcggaatgtcctttggcttcacaaattgaataaatgtgacatgatccttttgcatcgcaccaagggtatgaagatgtttgacatagttatttaattcattatctccgaaccattttgacccgataaacaccatcatgacatcggggtgctcctcaatgatgtccggcaaagcttgcaataatatgtgcgggcctttgactttgctaagccggccgacaaacaagacgatttttttgccgtgaagccccagctcgctacgcatctcttcgcgagcccgctgcccttcattcgtccagcgagggtggtacgtttttaaatccacaccagaatacaccgtttttgtttttgatcgtgctgacggaaaacggcttgtgatcgtctgtccgatataatcgctgaccgtaacaatctgcgctacggagtcgatgcaaatctcgccttccgcctggctgattttatcgtaagcgaacatttcattgtgaacgcttaaaataaaaacagcatccggcgcctgtttcttcaatttcggaacccagcttgggcgattacaaacatgcacaatatcaaaacggctctttttcagctctgctccaacggcttcttcataacggtcttcatccaaatgcacataatggacaccgtctaccttctctctatcagcgagattcggatctttaatagaaaacacagtcacctcatgttttttggcaattaaaggggcaaccgcttcgaggtagatttgaatggcgcctcctcgaaccgatgggacaggaagcttctctgtggcgatcagtgctattttcatacatagcctccattcctgcatgatttttaactagttagaatcatgatacggctgaacaaccaacttgtgcggaatgggactgccctaaaaacaaaacgggtaaacaaccagattcatctattaaatatagtcaaataactcaatcattttttccttttgattcataaggtaggagtaaaacaggtaaggatgtgtcctttaatggcagaaaaccatgaagtcattgaggaggggaattcatcagagcttcctttatcagcagaagatgcaaaaaaattaacggagctggctgaaaatgtgcttcaaggatgggatgtgcagactgaaaaaatagacgtcattcagggaaaccagatggcgcttgtctggaaggtccacacagactccggtgcggtttgtctaaaacgaatacacaggccagaaaagaaagcgttgttttccattttcgcgcaggactatttagcaaaaaaaggcatgaatgttcctggcatactcccaaacaaaaaaggtagcctatattccaagcacggctcatttctatttgtcgtatatgactggatcgaaggaaggccgtttgagctgactgtaaagcaggacttggagtttatcatgaaaggccttgctgattttcatacagcttccgtcggatatcagccgccaaatggcgttcccgtatttaccaaattaggtcgctggccgaatcactacacgaaacgatgcaaacagatggaaacgtggaagctgatggcggaggcggaaaaagaagatcctttctcacagttttatcttcaggagatagatggctttattgaagacgggctgcgcatcaaagaccagcttttgcagtcgacctatgttccatggactgaacagctgaaaaaaagccctaacctttgccaccaggattacggaaccggaaatacactcttaggggaaaatgaacagatttgggtcattgacttagataccgtttcatttgatctgcctattcgcgatttgcgcaaaatgattattccgcttttggatacgacgggcgtttgggatgaagaaacatttcatgtcatgctgaacgcatacgaatccagagccccattaactgaagaacaaaaacaagtcatgtttattgatatgctgtttccttacgagctttacgatgtcattcgcgaaaaatacgtccgcaagtcggctttaccgaaggaagaattagaatcagcttttgaatatgaacgcattaaagcaaacgcattgaagcagcttatttaagaccatcatttccccgcatatcggggtttgatctttataagataaagggtaaataaatacatgcggaggttgcaaatatgaaaaagattgtcggcgctttagccgtttttgtgattacatatgcgctgttttcagcctcaggctacctgtttcctgtggaccaagaatggtacaattcattgaaaaaaccggactggacgccaagcagaactgcgatcggcatcatttgggccatcctgtttgccctgatctccctttcagcagccattgtatatgctgcgttttcatttaaaggtgcgaaaagcttttggtttacacttttgataaattacgtgctcaatcaagccttcagctatttccagtttacgcaaaaaaatctgctggctgcatcgcttgactgcctgcttgtcgccatcacagcaatcgtattactgatcattgccaaaaaatacagcagagccgcaagctatcttcttttgccttattttttatggagtgcatttgcgacgttcttatcctttacaatcaattcaatgaatctgtgaacaaaaaaagccgcttatacagcggctttttcacatcatcggcttgatgccccaaatgtccttcgcatattcccggatcgtgcggtcgctggagaaatatccagaatgagcaatgtttacaatcgaacgctcagaccatttccttcgctcccgataatcagcttgaattcgctcctgtgcatctgcatatgagctgaaatccttcagcacaaaatactcatcattatgcggaagcagcgagtcaaagatcgattcaaattcatctgcctctccttcaaaaaaaccattgatcaactgatccgctacctgcctgattcttctgtcatgctgataatattccctcgatctatagccgccgttttcctgatacgatagaacttcatccgcctttaagccgaacgtgtaaatacaatcagggcccacccgctcaaggatctcgatatttgcgccgtcatgcgtgccgatcgtcaaagccccgttcatcataaacttcatattccctgtaccagacgcttccttgcttgcggttgaaatttgctcacttacgtctgatgccggaaaaattcgctcagccatagaaactctataattttctaaaaaaacaactttgatcagctgtttgactgccggatcataattgactttttctgcgacagaatggatcagcttaatgattttcttggcataataatagcttggtgaagcctttgccccgaaaataaaggtttgcgggtagattgaaaacccggcgtcctccttgaggcggttatacaaatacataatgtgaagaacattcagcagctgccgtttatatgcatgaagccgtttcacctgtacgtcgaatatgctgtcagggttcacaaccaccccggccgtgcaaaaaatcaaatcggcaagctcttgttttttcttgcttttgttgttttgaaactgttcaataaatgcaggatcagtggcgtacggttctaaacggatcagtgattccggctgtttgacccattcatcgccgatcgcctctgtaatgatggcagacaagcctggattcgcttttaacagccagcgcctgtgggcaattccattcgtcttattgttaaaacgattcggaaacagcaagtgaaagtcgcgcatctccctttccattaatatatcggaatgtatttttgcaacgccatttacactgtaactgcctactatggccagatgagccattttgacaacaccatgcgctgtaatcgccatgtcctctatccttttccagtctcccggatacttttcccaaactgcgcggcaaaacctctcattgatctcttcaataatcatgtacattcgcgggagcagcggcttaaacaaatgaatcggccatttctcgagcgcttctgacaatgttgtatgatttgtataagaaatcgtatgtacagtgatatgccaagcttcttcccagctcatgttctcttcatcgagcaaaatccgcatcagctcaggcaccgcaagcgcagggtgagtgtcattaatatgaatgctcacttttttatgcaggccggataaagatttatgtgtttttcggtaattgttcacaatgctttttaagcttgcgcatactaaaaaatactgctgcttcagccgtaaaattttcccctcatcatgggtgtcatcgggatataagaattcagaaaccgcttctgtttcccgcttataagacaaaatattaccgccgtgataatgcgcatagggctcagcgttccaaagccttaacgtgttgacagtgcctgtttcatagccgataatcgggatatcataaggaacagcggtaacaattgtcgcttgttcgtggcgaaaatgcaggcgcccgcttttttctgtcatatggacttcgccccaaaacggcacgtccactgcttgatccgcattccttacttcccatacgttcccgtttttcagccattgctcaggcagctccacctgatgcccgtctacaattttttgctcaaacaaaccatgcttatagcgtatgcccatgccgtgcccaggcaggttcaacgaagcaagagaatctaaaaagcaagcggccaagcggccaagcccgccgttgccgagacctgcatcgttctctatctgaaggatttcctctaaattgatgccgatttcctttaaaccagcttctacaacatcacgaacaccaagattcattaagttttgctcaaggagctgaccgagcagaaattcgattgataaataatatgtctgcttcccggaatttgatctgcttttttcattcgtctcgatccaatcagcgctgatatactctctgaccatattgcccaacgttttatattgatccagcttggcagaatctttaaagctttttccgcacgtcatttccagacgctttaaaaataagtctgcaaagcgttctttactcgagaacatcccgtccactccttgtcacctgctcgaaaatacgctgatactctttagccgacttcccccagctgtaatctgcattcatagcggtcttcacgatgctcttccatacatcctgttggcgataaaacgacagcgccctttctatcgtaaatttcagatcatgcgcattaaaggcagaaaacgtaaagccattgcccgttccctcttcctcctgataggcacggacagtgtcgtaaagcccccccgtttccctgacaatcggaatggcgccatattgaagagcaatgagctgccccaaaccgcacggctcaaatttcgacggcatcaaaaacatatcagagcccgcataaatttgatgggctagcggctcatcaaacccgatataagcccggcacttctcatgaaaagcaaattctgcataccggaaataatcttcaaattcacgttctcctgtgcctagcacaaccagctgtatgtcttgctcctcaagaagttcgtgcataattctgcggacaagatcaagccccttttgtttagtgagccttgtcaccatactgatcagcggaatatcgtttttctctggaagccccatccgctgctgaagcttcgttttgttttccagcttgcatgcaagatcccctgaatcgtattgcgcctctatataagggtcgcttttcggctgatagaacgtatcatcaatgccatttaatatgccggttacatcatcttccctatattgcaaaacctgttccaactgctcaccataatacggcgtcatgatttcatttctgtaagtggggctcacagttgtcacatgatcagccgcaatgatgcccgccttcataaaattaacaaatccgttgcattctaacctttcataatgaaaatgatccatctcaagacccagcaagtcatgtgtgacatcaggagggaatatgccttgaaactgcaggttgtggatcgtgagcacgcttttcatccgttcataaaaaggatgttttctgtactcctctttcagcaaataattgaccatcgctgtatgccaatcgtgagtatgaacaatatcggcttgaacattcacaactttggcagcctccagcacagctcttgaaaaaaaggcaaaccgctcaccgtcatcataatgcccgtacaacgaatccctgttgaaatagtactcattgtcgatgaagtaataattcacatcattctctgccatatgttcaattccgcaatattgctgccgccagccgacagctacggtacactcagcctgttttttcatacgctttttccacggttcaggtatttggctgtacttcggcagcatcacagctacctcattgcctaatcgcgcaagcgcctttggcagagcacctgctacatcggcaagacctcctgatttcacaaatggggtgcattctgacacagcaaataatatcttcaagaattcatcagctctccttgcaccaaaccttttcttaatacaagcggctgctcagctgttcctacagcttccgtcgccttgccgattttaacatccttatccgaaatgacctgctcaagaagacaatcctctccaatctgcgttttttgcataataatacagtttttcagcttcgttccctttccgacatggaccgccctgaacaaaatgcagttttcaacctctccttcaagcacacagccgtttgccaccaaagaatttttgacagtgctgtgctttccgtatttcgtaggcggctcatccttcacttttgtatagatcggctgctgcggcaaaaacacctgctgccaaaaacgaggctgaatgagctccatactgtgggtataatatttttccaccgaatcaatgacagccgcataacctgaatattcatatgggcaaatggtcagggcagaagattccttttcaacagcctcctgaatggttttatagcctttttcactatgtccgtagatcagatcctttaaaagcgttgttgacatgatatagatttgcagcgactggccgtcctgaaatacctcggtgacgtcgcagccaacctcctgatggcgtttcagcacatattgaaattgaatgttgcatacggtatggctgttggagataacagcatattgctgcgtgcttctgtggaagtaatctagatggtccgaaaactggcgaaaggaaccgaattcatcgtattcgtgatgaagatggggagacgggaaaaaaaagaggccgtcctttttccggtgcaaatcccattccttacccgccccaaggtgatccatgagcgaacggtaacgatacttcggaaaaattgcaacactcctaatatccgcattcaccatgttggaaagcataaaatcaatcagtcggtacctgccggcaaaagggatcgccccgagcgaccgctgtgctgttaaatcctgaagagaatgcttatatgtggtttcatctataacacctaacatttgattattgaacactgactctgccccctcttcagtaattaaatcaattctttttctacaaattcctctgaaacgagcagcacctcttcaatgtctttttcggagcgaatcactgcgccatccggcagcaccatcccattaggaacgatggcattttcaatgactacatgctccccaatcgtcacatccggcattatgacggatgatgtaacagtcgtatgcttaccgacagtcacaccttgaaaaagaacggagtgagacacatttccatatacaacacaaccttcgttcacaagcgaatcttgaacctgcgcatcagatgaaataaattgcggaggctgatttggattgacggagtaaattttccatttgcgttcaaacagcttcagctccgagtcctcttttaacaaatccatattggcttcccacaagctctgcaccgttccgacatccttccaatatcccttgaacggataagcagaaagcttctttttctcttccaaaagcagaggaataatgtctttgccgaagtcgtggctagaataagggttttgatcgtccatctcaagatactgtttcaaaagcggccaattgaatatataaattcccattgaggcaagattgctcttagggaatttgggcttttcatcaaaatgtgtgatcgtcccatctggattggccttcatgatgccgaaccggcttgcttcctcccagcccacttcgatgacagagatggtcacatctgctttcttttcaatgtgataatcaagcattttgccgtagtccattttgtatatgtgatctcctgataaaatcagtacatactcaggatcatactgatacaaataattgagattttcataaatggcgcttgccgtccctttataccacttgacttctgatgactcggcataagggggtaaaaccgtcacgccgccattatatctatccaggtcccatgcactgccgatcccaatataggaattcagctcaagcggctgatattgcgttaaaatcccgactgtgtctatacctgaattagaacagttgcttagggtaaaatcaataatcctgtattttcccccgaaagatacagccggtttggccatattttttgttaatccgctgagacggctgcccttcccgccggcaaggagcatggctacacattgttttttcatctttttatctctcctctttttttaaccgcccgtaaaatcgagatgccgtaaggggggatggtcatcgtgatataacacggtttatgatgaaatgctccctttttggccgataatggctttttgttgatttgccctgagcctccatatgtttcactgtcactgttaagcacttcaatgtattgagtgaaaaaaggaactccaacatcatattgatgatagaccacgggtgtaaaattacaaatgatgacaagcgcctcaccgtgctttttgccataacgaataaaagaaaagattgattgttcgtcattatggacatcaatccattcaaacgattgtgcacgatggtcatgctcataaaggattttgcttttttggtaaaagcggagaagatcttgcgtaaaaacgctggctttctgatgcatggggaaggagtccaaaaaccaatcaagctgttctgtatctttccattcatcaaattgggcaaactctgatcccataaagatcaatttctttccgggatgcactgtcatatagcccagcaaaagccgatactgggcaaatttctgccagtagtcgccaggcattttattaagaagtgatttttttccgtatacgacttcatcatgagaaaacggcaatacaaaatgctcactaaacgcatatagtaatgaaaaagagataagctgatgacaatgccgcctttcttcgggtggcgtctccatgtatttcagtacgtcattcatccatcccatattccatttataatgaaaaccaagccccccttcctcaacggcacctgtcacttgaggccattctgtagaatcttccgcaatcatcatcacatggggatatgcctctctcatggtttgattgagtttttttaaaaactcaacagcatatggattcgtgtggcgttcatcctgatttggccaatacaagatattagccactgcatcaaccctaaatccatctatatgatagaattccgcccagtacaacgcattcgaaattaaaaaactatgaacttccggttttcccaggtcaaagtttgccgtgccccataaccagttctcccgatcacgttcttctttgtattcataaagcggttctccatcaaacatatagagtccatgtgcatctttacaaaaatgtccggggacccaatccaaaatgactccgatattttgttgatgacattcatcaacaaacttcatcagatcatgcggcgtgccaaacctgcttgtcgggctgtaataccccgttccttggtatccccatgaacgatcatatggatgctcatacaccggaagcagttcaatatgggtaaacccatgctccttgatataagggataagcgtctgacttaattctttataggaataatgcctgccatcagaatgcttcttccaagacccaagatgcagttcataaatgaaaacaggtttttcatacagcgtcttagccttctgtttcttttgccatttttgatcttgccagctgtacccttccaaattgtaagtaagtgacgctgtgtttggtctgacttctgaataaatagcgtatggatctgccttcagcctgatctcaccgttattcgtcacgatttcatatttatatcgttccttttctcctatacctggaataaataacgtccaaatgccattatcattcactctgtgcatcacatgctcttctccagaccagctgttaaaatctccagccactcgtacttccgacgcatgaggcgcccacacacagaattcatatccgcttttgccattcagctcgcggtaatgcgagccaaacagctgatagcttttaaacagactgccttcgtgaaaaagataaacatcatgtgctgtcgggctggcagcggccatgtaatcatcctttctgacatcatagttttcatttatagtatttattcgaagaaataaaaaaaagccctttcctgaaagcgcttatacttatagacaattaacttcattttctgaagaaaaacgaaatatatggagatttttgtagtctgtttttaaaataaagaacaaaatctaagacatatcatgatttagaaaacaaaaaaaccttgcaggatatgcaaggcttctggatgacccgtacgggattcgaacccgtgttaccgccgtgaaagggcggtgtcttaaccgcttgaccaacgggccgataattatgatatctgtaatcatatggcggagaaggagggatttgaaccctcgcgccgcttacacgacctacacccttagcaggggcgcctcttcagccacttgagtacttctccatttggctccacaggcaggattcgaacctgcgaccgatcggttaacagccgatagctctaccactgagctactgtggaacaaaagtcatggtgggcctgaatggactcgaaccatcgacctcacgcttatcaggcgtgcgctctaaccagctgagctacaggcccatgacgatatagaaatggagcgggtgatgggaatcgaacccacgacatcagcttggaaggctgaggttttaccactaaactacacccgcaatttttatttggggcgattgatgggaatcgaacccacgacatcagcttggaaggctgaggttttaccactaaactacacccgcaatttttatttggggcgattgatgggaatcgaacccacgaatgccagagccacaatctggtgcgttaaccacttcgccacaaccgccaaaatatattgataaatggtggctcgggacggaatcgaaccgccgacacacggattttcagtccgttgctctaccaactgagctaccgagcctaagtatttaaatggcggtccggacgggactcgaacccgcgacctcctgcgtgacaggcaggcattctaaccaactgaactaccggaccattttaaaatttggttgcgggggcaggatttgaacctgcgaccttcgggttatgagcccgacgagctaccgaactgctccaccccgcgatgattaggaatatgtatggcggaggaagagggattcgaacccccgcgggctttgacacccctgtcggttttcaagaccgatcccttcagccagacttgggtattcctccgtatagtggtggaccttgtaggactcgaacctacgaccggacggttatgagccgtctgctctaaccaactgagctaaaggtccattggtagcggcggaggggatcgaacccccgacctcacgggtatgaaccgtacgctctagccagctgagctacaccgccaaatattttttgaaatcaagtggagcctagcgggatcgaaccgctgacctcctgcgtgcaaagcaggcgctctcccagctgagctaaggccccaagaatggtcgggaagacaggattcgaacctgcgaccccatggtcccaaaccatgtgctctaccaagctgagctacttcccgatttcatatagatcatggcgcgcccgagaggagtcgaacccctaaccttttgatccgtagtcaaacgctctatccaattgagctacgggcgcaaaacttaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcagaaatggtgcggatgaagggacttgaacccccacgtctgtaaagacactagagcctgattctagcgcgtctgccaattccgccacatccgcaacatgtaaatggtgagccatgaaggactcgaaccttcgaccctctgattaaaagtcagatgctctaccaactgagctaatggctcttcttacaagagacttgaatattatatcatataaaagtggtgccggcaagaggacttgaacccccaacctactgattacaagtcagttgctctaccaattgagctacaccggcatatatgtaaaaccgatatgtataatgaaaaatggtggaggatgacgggctcgaaccgccgaccctctgcttgtaaggcagatgctctcccagctgagctaatcctccatacttgcactaacgtgcaattgcttggcggcgtcctactctcacaggggaaaccccgactaccatcggcgctgaagagcttaacttccgtgttcggtatgggaacgggtgtgacctcttcgctatcgccaccaaacaaattgagagtgttctctcaaaactagataacaggtgtgacatcattcaaaatgtggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccgggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctagcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtaaagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtattactaattgaatgtgatgtctactgttatctagttttcaaagaacacgtttcgaaggaatgatccttcaaaactaaacaagacagggaacgttctgtttataagacccaagatcttatattccgtataatatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtaccgccctattcgaacggtacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtttgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggatcacaggttaagttcaccgcatcctgcggcgacacctgtgtgacctgcgtcgtgcaggccctagtttgactgactacgcacatcgctgtgcgattttttaaaactgaattaacaggtacgttttgtcttgtttagttttcaaagatcatttcgttacttctcaatgaagcagctttactaatataacattcagcttcttttttgtcaataactttttcaagttgttttgaagcatctagtttgtgtccgctgtgcatcagcgacgtttaataatataacacctgtatttatttattgcaatagtttttttaaaaaaatctataaaacaaataaactataatcctcgccatgatttctaaagcgtgtgtatcatataactttcttaaaagaacatatacatcagtcatgtgatcttgttgtttttttcgttttcttgtatagtagaaacgaactaaatactgatgaccacaaggggagcattaaagctgagagtgagcggtttcgttctgaccctttgaacctgttagttaacgctggcgtagggatgtggcaaagtcaaatgaattgcagatcgtaaagcagtgcgtggaacttttctcatccttccgcgtgctgcttttttgttgtccttttggttgtctgtcaatggaaggagatagatatgaatcaatctaagcaactggttcgccttattgaaattgccattatgacagcggcagccgttattttagacattgtctcaggaatgtttcttagcatgcctcaaggaggctcggtctccatcatgatgattccgatctttttaatttcgtttcgctggggtgtcaaagcaggtcttactacaggtttgttgacaggtctagtacaaatagcaatcggaaacttgtttgctcaacatcctgtacagctattgttagattacattgtcgctttcgcagcaatcggcataagcggctgtttcgcttcttctgtccgtaatgctgctgtatcaaaaacaaaagggaaattgattgtttcagtggtaagcgcagtttttatcggcagtttgctgcgctatgccgcgcatgtcatttcaggagctgtgtttttcggcagctttgctccaaaaggaacaccggtatggatttattctttaacttataatgcgacttacatggttccttcattcattatttgtgcaattgtcctatgtttattatttatgacagcaccccgtttgcttaaaagtgacaaagcgtaaaaataacaatcccccagcgaattccgctgggggatttttcgttatctgttaagaagtgtttttaaagctgaaagatccggccagccaagacctacttctttcagccttactccggcaatttcaaagttgtcctccgctactctttcaggtgaataggcctgataaaatataatcgagggattctgctcaataacccaaacaaacatacttgaaaaaccatgttgaagcaaaaactccgctccttttgctaagagcgccctgcctgcaccttgccgctggcgctcttccagaagataaatagcgtataactcgccgtcatagccttcttgttcagagcgaataggtccaaatgaagcaaagccgaatactgaacccatttcgtcctgagcaacaaatactccctttaacgagcgacttttccatttgtcttcaaattccttatagttcaggctgtttaaataatcaatcgggatagtttcgtggtatgttgtcctccagctgtctacatgcacttttgcaatgccctttatatcctctaacttcgcttcacgtacagttaccatacggttctgtcctttccttactctgatttttggaccgttttggcttctttgatttcatttgttaattcattgatgctttgttttacgtttccttttcctgaaaagttctcaagcatttcttttacatcgattcccgaggatgcttttaaactttcttgcagacttgacattaagttcgtcgcatagctggttactttgtttgctccgcttgattcaccgcttcctcctgtatcgacaacagtgattttatcaatatttgaaagaggtgccgctgcttgtttcgcgtattccggaagcattttgacaatcatatcgaaaatcgccgcctgcccgtactgttcaaaggcagccgcaattttctcttttgcttccgcttctgcaagacctttcaggcggataacctctgcctctgtctctcctttcgctttttctgcttctgcttttgctagcccgtcaattcttactttttccgcctcagcctttgccattgcttcaatactgtacttcttggcatcggcttccgcgagctgtttggctttctcagctgctgcggactgctcaacagaataacggtctgcatcggcttttttctttacctctgagtcgtattgacgttcacggcgaagaatttctttttcttctagctctatttgtttttggcgttcgataattttaacctgcatttcctgctctgtgacttgctggcgcgctctggcagtctctaaatcatatgcctgatcggcattcgcttttgccgtatcttgttctctgcggaattcagccatcttgagctgattgattttttcagcttcagcgatttccgtcgcccgttcaagttctgatttttttgcgtctttatcggcttctgcccgcttaattcgggtttctttatcagcctctgctgttgcgatatcagcatcgcgttttacttgggcaattctcggtttccctaatgattcaagataaccgtttttatcacgaacatctttaatggtaaacgagacgattacaagccccattttcgcgagatcctgtgaagcgacacgctgcacctcttgagagaatttttctctgtttttatagatttcttctactgtcattgagccgagaatggaacgaaggtggccttctaaaacctcccgcgcttcctgctcacggtcgtcttttgatttccctaaaaattgttcggccgctgtagcgatttctcctatagaaccgccgattttaataatcgcagttccatcggccattactggcactccttgttctgtatagacttcaggtgtcgaaacatcgagtttgcttgataataagcttagcggctctgcctgctggaagacgggaaggacaaaggttcctccgccgcggacgattttaatacggttgccgccttcatcgacatgaacatttttattgcccagatagctccctgttacaattaacgcttcatcaggccctgctgtacgatacttcgtaataaacacagctattagtgcaattaataaaaagaatacaactccgatgatcattataatcggcattgtcatatcaaattcctccttttatgttaaatgggttcatgcggagtaaccgaaagaactccgttgttaatatctacgactaacaccgttgtcccgtaactgatctgctgattatcaaaactgaccgctgactttgaaatggtgccgcctatcccttctatgaccacttcaccaaacccgtcaaccggaacagctgtaatcactttaccgagtcttcctctgagatcatcttctctatatgccaatgattcttctgcagatgataatggtaccagtacaaagatgtgaagcaataccaccagcatgattgaaaggatgcaagataaaagcgcaatcagcaagctcgacagaggcaatacgagttcacctatatatccgcccgctgaaaaacatgtgaaaaatgagagcactaatgtcggattaagaaacggaatgccttctggcagccctgcaaatacatctccgaaaaacaggaataacagcgtaaggctgcccgcaataataagcgtataaagatacattgtttgtataggtactccaaataactccaacttcctcatcctttcttcatcaatgcattgatgaacggctgccgttatcatttatacgagacaccacaggaaaagtttcaaaattttaagacaaataacccatttgaagtgctttataaatgataattgcttatatatatggtaatgtcattttaggaggagatatgatgagtatctttaatgaagccagattagaaacgtggaacgaattgaaaggactttctgacgaaaagctgaaccaaaagccttctgctgaagaatggagcatacgggaagttcttgaccatttgaaaaaaatcgatatgaccgcacaaaaaatgttgaaggaacgtgtaaaggacgctccgattaaagaaattgaagaaaaaccgcttgaggtagcacaggacagaaataataaacggaaagccccgagtcatcttgagcctgcgcatgattttatttcaggcagccaaatgaaacgtgagcttgatgtggtaagagagcagctgactgctgcgattgcctctctgaaagaagaagattttgaaagagtgcttccgcatcctgtgtttcaagagctgactgtcagacagtggatcgattttatcggccatcatgaaaaacggcacctcagccaaatgaaagaaattaaagaaaagatagaaagggcctgatttgatcagaccctttctgcttttcgtttaacttttcgctgataggaatgaacttctatttcatcacctgtgtaaacagcacctggtctctccacaatacagacaatccctctaatgcccagtgcgtggcggacgaaagccggcgccagcttcggttggtccggataataagactgaatgacttctcccggctggatacacggatcattttcgccctcacacagcagagccgctccgctcggaaaaataatccggcttccttcttttaatgaagtaagatttggcataccactgactgccacattcgccccgagccattccggcaaaatccttggcactcccatttttaaagcgatttcgttgcattcctctattgaaacaattgaaatttgtctgcggttgaaaatttcagtccctcttgaaaacattggttctctggctcccgcttttttggtcaggccaaaatgcaagtcgccgggatgccgccataatcaaaatcaagcttgtccatttgctttgttacgaagctatctgtatctgcgatatataagccttccgcttttgcagtcatacgcttccacatcagctggcaccttccttcttatctaaaatttccacctatgcttcattatcccaaaaaatcccgctctgtaaaggagcgggattttgattataccgttttaggcgtaaggttaaagcagcgcttgtagatccagttgtatgctttttcatttaaatctctagggtttccgaaggtttgcggatctttcattgcttctttagacaagcgttcgatcatatcaggtgatactccctgctcttctaaagtcggcacttctaaatcttcgaccagatcatacatccaattgacagatgctttcgcagcttcttctgttgtcatcttgcttgtatcaataccgaacgctttcgcaatacgcgcaaacttctcaggatagcccttccagttgtattccattacagggcccatcatcgccgctacacattggccgtgagcgactgggataataccgccaagcgtttggctcatcgcatgagccgcgcccgctgattcacttccgtaagaaaggccggcaagcatcgcagcctgcgccattccgtaccttgcttccagatcctctccatcagcaaatgccctcttgatgtaatgagcggcatactcaatcgccattaaggcaaccgcatccgtgattggctgtgcaaatttcattgtatagcattcaatggcatgggcgagcgcatcaattcccgtcatagctgttacatgcggaggcattgaaacatgaagctcaggatcaatgattgtcaagtgcgctgcaatcagcggaccgcccgtgttgaatttgaattctctttcttcatctgtgataaccgcccattgggttacttctgatcctgttccagctgtagtgggaattgtcgtcagcggaggaatgcggttttccagcggttttttcccatctgccgcttcataatcaagcacgcttccttcgtgagtcgcttctactccgattgcttttgccgtatccatggagcttccgcctccgactgccaccaaaccattacagttctcttttttgtaaagctcagatccttcattcaccagacggacaggcgggtttggctcaactttattaaagagcaccacttcaatgcctgcttctttaagtgattcgattacaggatcagcaacaccggctttataaatccctgggtctgtgacaaggagcgcttttgaaacgcccagtgcagctacttcctcacccgtatgcttgatggctccgattccatgcttaatcacagtcggaatttcaaatgtgtggaatttctgcatgctttctaccttcatatttaatgtcatcatcaatctccccctcttatgaattgaaccagttaaccgctgccggttttgtattacggtatacatgtttgacttctgtgtattcttcaaggcctatttttccaagctcgcgtccgaacccggattgcttatatccgccccatggcgcttgtgcaaagtacggatgaaaatcgttgatccaaacggttcccattctcaagcgggctgctacccgttcgcacttttcaatatcttttgaccataccgctccagccaagccatagatggtatcattcgcaagctcgattacctcttcttcagagctgaaggtttcgactgtcaatacaggaccgaaaacctcttcctgaacgattctcatgtcagaattacagtttgagaaaatagtaggttcatagaaaaagccgttttgaagcgcaggatcttccgggcgtttgcctcctgtctccagcttcgcgccttcctctattccgatctctacatatttttctacctttgccctgtgctccgccgaaataagcggaccgctttctgtctcagcatgaaaaccgtttccgagttttatgcgttttgcccgtttgaccagctccgccaaaaattgatcatgaatggcgtcctcaacaagcaagcgggaacctgcagagcatacttggccggcgtggaaaaatacagcgtttaaggcctgatcaaccgcaacttctaaatccgcgtccttgaaaacaatatttgggtttttcccgccaagttcaagggcgatttttttgacgtttccgcttgccgcccgcatgatttttttgcctgtttcaattccgcccgtaaatgaaatcaaatcgacgtctctgtttactgcaagctcgtcgcccactgtggctcccggtccaagaacaagatttgcgacaccttttggaacaccggcttcttccatcagcttaaagactttgattgtcgtcagcggcgtaatctcactcggcttcatgacgattgtgtttcctgcagccagtgcaggggcgattttccagctcgcttgaaggagcggataattccatggagtgatctggccgcaaaccccgattggctctctaataattttgctttctgaatcaggaatcggagatgaaatgatctctccgccatctttgtctgccaagccggcgtaatattgaaaaacattggcgatatcgtccatatcggccttgctttcttcgagtgtttttcctgtatcaagagattcaagctcagccagctcctcaagatcgcgtctgattaattccgcaattttcagaacaatttttccgcgttcaagcccggatagcgaagaccattctcctttgtcaaatgctctgcgtgcggctgcgattgctttgatggcgtcctctcgccctccctcgcttacagttgcaatttcttcttgattaaatgggttgataatactgcggatctgttctttttcggcactgatccattctccgtcaatgaataatgtttgactcatataagcctccttgacgtaaataaagtttgttaaataaaaatttaatgtttttaacaaccctaatctaacatatggtttttaaactgtcaaagtcccatttcgatttttctttttgacttttcctcatgtttcgttaagataaagaacataaagaaataacttaacgaatttaattttctaaaggaaaagagggtcagtatggatgaaaatccagaatttacagctatagaacaggctcgggatcttgttattgactccattgctgaaacgatggatctttacggaattacccgcagtgtcgggattttatatgggacgatgtatatgagggatgagatgacgcttgacgaaatgcgtgaggagttgcaaatgagcaaaccaagcatgagcacaggcgtcaaaaagcttcaagacttaaatgtagtgaaaaaaacatttcaccggggcatccgtaagcatacatttgtggctgagaaggatttctttaaatttttcacaaatttctttccacctaaatgggagcgggaggttcaagtgaatgtagcagcgatcgaggaagctcaagctgatttacaaaaggttttaagcaaggaagatctcaatgatgatatcaaaaatgaagcactgcagttatatgatcagctggaaagctctaaagcttactatgactggctgaaacggcttgctgaatcggtgcagaccggagaaatttttaaatttataccgattgaaacaaagtaaagcagaaaacgcctgggaaaccaggcgttttttgatataactactacaaatttgaaaaatacgggaaaaacaccccatttacttccaaaatatttgatggtaattttatgtaggtaaaatttgtatttggcctttcagaggaggtgaaaagcgggcaggcctgtttaatttatcattttttagggggaattttgttatgaaacgcaaattattatcttctttggcaattagtgcattaagtctcgggttactcgtttctgcacctacagcttctttcgcggctgaatctacatcaactaaagctcatactgaatctactatgagaacacagtctacagcttcattgttcgcaacaatcactggcgccagcaaaacggaatggtctttctcagatatcgaattgacttaccgtccaaacacgcttctcagccttggcgttatggagtttacattgccaagcggatttactgcaaacacgaaagacacattgaacggaaatgccttgcgtacaacacagatcctcaataacgggaaaacagtaagagttcctttggcacttgatttgttaggagctggcgaattcaaattaaaactgaataacaaaacacttcctgccgctggtacatatactttccgtgcagagaataaatcattaagcatcggaaataaattttacgcagaagccagcattgacgtggctaagcgcagcactcctccgactcagccttgcggttgcaactaatgtaaaagaccggttaacgccggtcttttttgcgttttaccctcccctttttctctaatccccgttatcttttttctggtttaaaatttaaattgacaaacactagaaacaggagtaaattcttgagtgttcaatttcatacagtctcttttaccgcttaatcaaacacgaacgggggaaccaacgattggctgttttattaacagccttggggtgaatcttactaagtaagagggggtactctgaatccctaatccgacagctaacctcgtaggcgtatacagagaggaggtctattatcggccattctttgcaatggtcttttttgcttcaaaaacgttaattcactaagggagatatgaacattgggaagaattaaaaataagcaatttgccgtgatcgggctgggccggtttggcggcagcatttgtaaagaacttcatagaatggggcatgaggtccttgcggttgatatcaacgaagaaaaggtcaatgcatatgcttcttacgccactcatgcggtaattgccaacgccaccgaagaaaacgaattgctttcattaggaatacgcaattttgaatatgtgattgttgccatcggagcaaatattcaagcgagtacgctgaccaccctattattaaaggagcttgatattccaaatatttgggtgaaggctcaaaactattatcatcacaaggtgcttgaaaaaatcggcgctgaccgcattattcatcctgaaaaagatatggggttaaaatcgcacaaagcctttcagacgaaaatgttttaaattacattgatctatctgatgaatacagtattgtcgagctgctggctacgcgcaagcttgattcaaaatcgattattgacctgaatgtaagagcaaagtacggctgcacgatcctggccattaaacatcatggagatatctgtctttccccgcgcctgaagacatcattcacgagcaagattgcctggtgatcatgggccacaaaaaggatattaaacgttttgaaaacgaagggatgtagacaaaagtgacacttcaaaaggataaagtgatcaaatgggttcggtttacaccgcctcaagtgcttgccattggttttttccttaccattatcctcggggctgtcctattaatgcttccgatttccactacgaagccattgtcatggatagatgccctttttactgcggcttccgctacaactgttacagggcttgctgttgtcgataccggtactcaatttacggtattcgggcaaacagttattatggggctgattcagattggcgggcttggatttatgacatttgcggtcttgatcgtcatgatattaggaaaaaaaatcggcttaaaagaacgaatgctcgtccaggaagccttaaaccagccgacaatcggcggtgtcattggccttgtcaaagtcctgtttctgttttcaatcagtattgaattgatagcagcactcattttatccatccggcttgtacctcagtacggctggtcatccggcttgtttgcaagtttgtttcacgcaatatctgcttttaacaatgccgggttttcgttgtggcctgataatttgatgagctacgttggcgatcctacagtaaacctcgtgattactttcttatttattacaggagggatcggatttacggttctgtttgatgtgatgaaaaatcggcgttttaaagctttttctttacatacaaagctcatgcttacaggaacgctgatgttgaatgcgattgctatgcttgcgatctttattttagaatacagcaaccctggcacgctcggccacctgcatatagtggataaactgtgggcgtcctattttcaggcagtgacgccgagaaccgcaggcttcaattctctagattttggaagcatgagagaaggaacaattgtatttactttattattgatgtttatcggagcaggaagcgcatcaacggcgagcggcattaagctgactacgttcatcgtgattttaacatctgttattgcttacttgagaggtaaaaaagaaacggttattttccgccgttccatcaaatatccgattatcattaaagctttagctgtgagcgtcaccagtttgttcatcgtgtttttagggatttttgccctgacgatcacagaacaagcgccatttcttcaaattgtgtttgaaaccttttccgcattcggaactgtcggccttacgatggggcttactcctgaactgacaacagctggcaagtgtatcattattgtcatcatgtttatcggaagaattggtcctttaacgttcgtgttttcattcgcaaaaacagagcaatcaaatatccgttatcctgatggcgaagtgtttacagggtgatatcaaaaaaatccggcgtgcagtcgccggatttttttatgattcgatatgagattgattttgtcttttttcctgttccgcgatgatttcattatcctccgcgttatcacgggttactttttgtgtaagaatcgcaccaactgctacaagtatcataacagcgatgtaataacctttttcattgagttccaggttatcagcattatagagtccgatactaaacaaaaatactcccgcaaaaaaagtaaaataagctaatactgtaaaggcaaccgtgtttctgcgtctatatttctgcacctttgttccctcccgaaagcatagttaaaaagtgataacttccgtggaatattatacctcaaattccccgtaatggaacagagaattaaaaataccagtaaaaagggcttaggttgcctcctttatttcaacagctgaatcatcaatccagccgataagtttatcattgatttggaattggtaccatacagactggcctttctgttttctagacacaacctttatgtctttgccgacgtaagattgggcagaggtaagccttatggaccgatcatcagtagagggcttggaccatacgtcttgaacggcactgtctttaatagaggcgtttaaatccacagatttgagggatggatttacctcatcgtactcatctaaatcgtatttttccacaatagcgctgattttgtcagcatagtcaggatctgtagcatatcctgatgtttgcagggcggttgccgcttccttataattccctgcctcaagcaccggtttatacttctttttattccacgatgtgccacggacgaacaattgggcgtgatcatccatagattcaaaaaacgtgctgtattttcgaaacttcgcgcgaatggtttttcttttccctttttcaacttcgtccgtttccatcgtgacatgatggcctttataattcccttttacgccaaaaaggttgttggccttagcagccagttcactgttcccccagtccgattcgagaatggcctgagcaattgtgatgctggggagaacatggtatttttcatacaaaatttgggcatgtccggacagactgtctataaatacttgctgttcatcgatttcttcagtttctttggatgtttcaatcggttttgataaagttgtcgctaaaacaaacagagctagcggaatcgatacaatgaaaaatagtgaaatcaagagtttacgttttttaagttttttacgggccatgaaaaccttccttcgaattaaaagattacgaatgtaaaagaatctaccttttagaattttacttgcacttctaatatttttcaattctttagggataaagttgggaaaagattgcaaaataaaaaccttttcgctcaatgaaaaggtttttaccatgtttctatttttgtaaatttctgagtgcattacgatattccgtatcatttattactttatatgatttgacagttgccttcgacaaaccttctgctgaaacggccggtttttccggagctgttttcgctttatcatgtggtttatgtgccagcttgtgccccattccagtggcattcatacaaaatgacaggcagacgagcagcacgctaaggataaaagaaatgaagaagagatcatgataagcagtcatcatagaatcctgtaccgaaccgctttgtctggcagcatcttttttcgtgaaaaagccgatgagaataggaactcccatatagacaaacaatcttaaaaactgaacagctgtcattctcttgaccaaatcaggcagcgggcctcccatggcagctcccatcagccctgcggcgactgtcaggcctgttcccgctgcaagcatgataaacagtgccgcgaacatataaagagatgatcgatcctgcatatgcagccattgaaaattcacaaagacgagaatgagtccgccgataataccgagcatccctggtccgactttatcataaaacagagcgctcaaaatggccgcgatcgccactccgattaaaagagtcaagtttaaaagaatgagatgctcctgagaaatatcatacatttgacggagcaagccttgaaaagcagacaggctgacagctaccgttatcgtccctgcagctatgatcaataagccaagcaccggttttggcagcagcatcagtttaatagatatgaatgggtttttcactttatattccacaatcaatagaccaatgagcaaacataacgtcaccccgaaaccaatccatacataacccgatgacagcccccatttttgcagaaaaatgaatgaaaccgctgaggctgcggcaaggaaaacagataaaagaattcccgcacgatcaagcggctgttcttgatccgccgctccgtgatgctcgtcatggagaaagaaatagctcaccgcgacaccgatcagggacaaggtgccaaagatgaaaaacagccatctccaatgcccgcagcttgttgcaatggttccgaggattgtgccgatgataacagaaccatagaatcccccgatcagcacaagcagtgcatagttcctgcgttcaatcgggaatgacagtacaagcattggaatcataatcatcagcatgacgcctgttgccgccccctgtaaaaagcgccctgccgccatccatgcaatatcgcctgaacatgcgatgagcagtgagcctagtataaagacaggtaatgaagccagatagacgggacgagcaccgaattttttcctcagcagcggtcctgccggaactaacaaggcaaaggccatattgccgatcaatatcggatttactgatgtgaagacacttgttccaaccgctttctgaacaaggccttgaactgacgacaatgccgtgttagacatcaatcccggcccgaccgctaagacggcgagcaaagaaatcacccaatagtgttttgtcttcatgttgtcattccttcctatatgaatacatgcgaaacacatcattttttgaaaacaaaagaagctaatagattttgcataccattagctttcattctaatattatccctttcaggggaaatgatattattttattataattatgtgaatgaatgagcatatactcaaatattatttcaaatcgattgtgttttgtcaatggagtaaatttcaagcacaacatagaaagcttgaaagcttttccccgatattgtgttttggagccaaggggcctagaactgcacttatggagccctgctcgttccctcaagcgaattaaatcaggccgttttaatcctttcaatccactattccaactaataaactcgaataagttggtgataagacaacattttggccgcacatttttttgtgttcactgggcgtttgccgcctctaaattgtatatgggtaaataccatgaattaacctatgaaataccaatgtaaggaaattctaaatattccgggaggcaaaaacgaatggaactgtatgagtgtatccaagacatttttagcggcttgaaaaatccatcggttaaagatttagcaacgtctttaaaacaaattccaaacgcagcaaaattgagtcaaccgtatattaaggaaccagaccagtacgcttacggccgaaatgccatctatcgaaataatgaattagaaattatcgtgattaacattccgccaaacaaggagacaacagtacacgatcatggtcaatccattggttgtgcaatggtgttagaaggaaagcttcttaattctatttatcgttcaaccggcgaacacgcagaactctccaattcatactttgtccacgaaggagaatgccttatttcaaccaaaggtttaattcacaaaatgtccaatccaacatccgaacgaatggtgtctcttcatgtctactcccctcctttggaagacatgacggtctttgaggaacaaaaggaggtattggaaaattcatgattgacagataaactgctcactttgacttcgctcaactggaggattcagagaatgaaaccttttcctcaaaacaaaaaaacccttatagaataagggtttaaaggtatggagccaagggggctcgaacccctgacctctacgctgccagcgtagcgctctcccagctgagctatggccccgtatgtaacgtcatgtttattatagatgatttttttttgaaaaacaagctgtttcctcttgaattgacagaaaaaataaggctcggaaaagagccttatttttcgacttacatcatgatcaaaagtaaaatcacaccgagaataattcgatagattgcaaatgggacaagtttgattttgttaatcagccttaagaagaaacggacgacaaacagtgcgaccacaaaggcacagataaagccgacgatgaaaaatggcatcagatccgagcttaagctgtcccaatgcttcacgaggcttagaaagctggctcccatcatgatcggcatcgccataataaacgtaaagtcggctgcagctcggtggtttaatccgagaataacaccgccggaaatggttgaaccagaacgtgagaaacccggccaaagggcaagacattggaataagccgactgctatcgcctgtttataggaaatgcggtcgagtgtgtctgtcgctgttttccgcttattgacccagtcagcaaaaagcatcaggattgccccggcaattaaaccgatggccacagttttaacggaaaataaatattcatcaatgtaatcttcaaacaaaaagccgagaacagctgcaggcacgagtccgacggcgatttgggcaatgcttaatttatgtccctgctcctggtcgcttgtaatattttttttcaaaccgagtaaatttaaaattcggtctttaaacacgatagctactgctaaaatggagcctagctgaataaccaccttgaatgagttagcagcttcttctgacatcagattacttgatttaagccagatgtcgtctactatgatcatatgtcctgtcgaagaaaccggcgcgtactctgttaatccttctacgattcctaaaatggcggctacaaacaattcccatagagtcatgattttgattctccccattagacatttatttttttacataacgggagctttccataaatggaaagcccgtcttatataactataaacgaaaatcacactttatgacccggcgtattttcatttttttcttcgtcgtataaatgtgaccgcattttaaaccagtcaaataaatgtgtcgtaatgactttagcaactgcatagcccggaatggcaagaatgattccaacaacgccaaacagtttgccagctgttaacagcagaaaaataattgtgatagggtggatgtgaaggttttttcccataatttgcggagagatcagcttcccttcaatcagctgaacaatggtccaaacgatcaccaatttaagcagcataagcggcgatgtcactatggcaatgataatcgcaggcgtaatggcaatcgttggccctaaatatggaacgatgctagtacaagccgcaatgacggctagcaatgaagcataatccagcccgataatcaaataaccgataaacagcaaaaacccgatacagaagctgacaatgatctggcctctgatataagagcttaaccgatgattcatttcgcttaagactgtgtatgtctgttctttcaattgcgtcggaacaaacttcagtatgtagaccggcaatttttttccgtcctttaacaaatagaaaaggataaacggaaccgtaacgattgaaatgataatctcagtcagggcgccgataaaattcccaacgccggtaaaggtactgttcacaattgtcgctgcctgatctgaaacctttgttgcgagatcagatatattgatgttcgtcgtttgctgggcctgattgacgaagttgctgccgatcagctgtttcgtctgattttcaacgatatccacatatcttgggatgttgtcgattaaactcataatttgttcttttaagaagggaatgatcgacacgattgtgatcgtgatcagcccgataatcaatagatacaacagtaaaatagaatagattcttcttattcttcttctctcaaggaaatcgacgaccgggtttaacagataaaaaacaatgcctgtcaaaataatcggaagtgatatcgttttgagcaaaacaataatcggggtgaaaataaatgatgtttttgtaaatactagaatatttaaaccaatcagcagcagcacaagcaaaaataaaacaaacttattgtccaagaagaatcgcttgaatctgccgctccatgtttgcaacgtctccactatcgttcctccgtcatacatagtttaattaaattgtacactatcgtccctataatgaaaaataaaaaccgttaattgctggaaaagctttcacggttttaacattctatttatatctatcatgtgattttgttctttttaagctataatttagctatatcatacaaaaggagcgatacgagtgatacgttttgcaataataggaaccaactggattacagaccgctttcttgagtcagcagcggatatcgaagattttcagctgactgctgtttattcaagatcggctgaacgcgctggcgagtttgctgctaaacacaacgctgcgcatgccttctcagaccttcaggaaatggcggcgagcaattgctttgatgccgtatacatagccagcccgaacgctcttcacaaggaacaagccgttctctttatgaaccatggcaagcatgtcctttgtgagaaaccgtttgcttcgaatacaaaagaaacagaagagatgatctcagcggctaaggcaaacggcgttgttctcatggaagcaatgaagaccactttcctgccgaatttcaaagagctgaaaaaacacctgcataaaattggcactgtccgcagatttaccgcaagctactgccagtattcctcacggtatgacgcgttcagaagcggaactgttttgaatgcgtttcagcctgagctttccaatgggtcattaatggatattggcgtctattgtatttatccggctgttgtgttgtttggcgcgccgaaggatgtaaaagcaaacggatatgttttatcttccggagtggatggagagggaactgtcattctgtcttacgacgggttcgaagctgttctgatgcattccaaaatctctacttcctatgccccggcggaaatccagggtgaagacgggacgattgtaatcgatacgattcaccggcctgaacgtgttgaaatccgctaccgggacggccgccttgaaaacattgcgattcctgatcctaaaccggcgatgttctatgaagcagaagaatttgtcacgctcataaaagagaataagctggaatctgaagaaaatacatttgaacggtctttgaccactgcaaaaattatggaggaagcaagaaagcaaatgggaattatataccctgctgatcaagcttaaaaaaatccgcacgcgtgcaaatgccgcggcggattttttattagacaatcggagaagatgccttcctttttaaaagcacctgttgctcatattctttgatgtcatgaagccatgcctcttttaccggaacgcccatttgctcacagtaggaatcccagatggctccgaaaggatatgttttgaattcctccatcagggccagcctttctgtatagcggccctcttcctgcaattgttttaaatagccgttcgggagaagcaaggcatacaataaagctttgatcatatttctcgttccgatggtccaggcggctacacggttaatgctggcatcgaaaaaatccagaccgatggcgaccttctcaagagcctgatttcgtacaatttcaagagcgatttctctcaattcatcatccaaaaccactacatggtcgctatcccaacgaacaggccgagatacgtgcaaggcaagcttgtctgtgtaaagcagcatggacgagatcttgtttgataccgtctcagtcggatggaaatggcctgtatcaagtaaacaaagcttatgattcgtcaaagcataagctaaataaaattcatgagatccgacaacatatgattcggagccaagcccgaacagcttgctctcgattgaatcaagattgtgttgttcactgatctcctctgcgaagatccgatccagtgattcttttagtcttttacgcggtgtcagcctatcactcgggatatccttatagccgtcgggaatccaaatattcgtcaagcaaggtgttcctaattctttcccgaagtattccccgatacggcggcaagcgatgcaatgcctgatccaaaattctctgatgtccggatcagggtgtgaaagggtgagtccgtcagccgctttctcatgcgaaaacaaggtcggattaaaatctaaaccgagaccaaggttttttgcccatttcacccagttttcaaaatgctgcggcttcaattcgtcacgttctaccgcttccctgtttgtttctgcgtatatcgcatgcaggtttacgcggtgctttccaggaatgagagaaagagccttctccaaatcttttcttaattcttcaggagtttgcgcttttccgggataattgccggtcacgtcaattccgcctgaaagctcgcccttatttacttcaaagcctccaatgtcgtcaccctgccagcagtggatcgaaatgggcacttgctctaattgccgaagcgcctcttcaacatcaattccccatttttcatatgcctgttttgcactgtcataattggcttttatggtcatacggctctctccctttatcagttttttaatccaaataaaaaacttcctttagatctatcgaaacaggactgaaatccgaatttgttttcattaatggcgccatcgatttccaccatcttcggcaaacttccgtgtccgccatctttctccatttctcttcatcctctatttctaaatatgcaaaaagcctgcctgtttcctcgtctagaaaaatggaataatggtgtgctccatgagctttgagtgcttctgccatctcaggccaaatgtcatcatgccgctgtttgtattcttcatacttgtcttgatggacaaacatgatactggcttttcttttcaaactttttcacctcttcatcatttagatagcgctttcaaaacagtttgctgaaatgactgaatgatcgtgcttctgtcaatgtctttaggtgtaaacactttgatcggaaaggaatttctgacgacttgccgggcttcttttatgtctttgacttctttggcagcaatcatttgcatcaaaagatttccggtggcagttgcctctatcggccctgcatataccgcttttccactcatgtctgccgttaattgatttaagaaatcattccgggctccgccgccgatgatatgaaattgctcgatcggtttttctgtgattgtttcgagctctttgatggctatcgcatagatgatggctaaattgctgtagatgcagcaggcaagttcgcctgcagtacggggaatcttttggcgggtttgtctgcaataatgttgtatttcctttatcatgttttctggattcaggaatcgtttatcatttaagtttataaattgctggaatggttctgttttttcggcttcttctgcaagctgctggaaagagtaatctgcttgtaactgctgtctgacttcttgtatcacccacatgccgataatgtttttgagaaagcgaatggtgttgtttgcgccgcgttcatttgtatagttgttttctaaagcaagatcagttattatcggtgttttgttttcaatcccgattaacgaccatgttccgctgctgatatacgcccagccatcatttacgcctggcgccgcaatgacggccgaggccgtatcatgtgttgcgactgtcatcaccttgcacgccgggagatcataatccgggaaccactcatttcttagcttcccgagctcacaccccggttcagtcagcggcgcaaattgctgttcctgaacggacacggcttcaagcaattcaggatcaagatttcccgttgaggcgtttaaaagctgtgttgtggacgcgtttgtgatttccgttactgcttttccggttaaacaatagcctaaataatcaggaaccatcataattttgtctgtctttttcagcagctcacggtcttcttcatacaattgatagatcgtgttgaaaggctgaaattgtattcctgttttttgataaattgcggcttttgagagggtatgttccagtttgtctattgtgtgatctgttcttctatcacggtaggagattgcttcccgcaaccgatcgcctttttcgtccagtaagacataatcaactgcccatgtatcaatgcctacggtgcagtgttcatacccaagcgtctttactttttgcagtccttgcaggatttgttttagcaaatgatcaatatcccaaaagcaatgcccgtctctttgactgaaaccgttagcgaacctgtgaatctcttgtatgtcaagcttcccttcattcagttcacctaccatgattctcccgcttgatgcgcctatatcaatggcagtataaatcatcctttcaccctctcttcgaaagaggaacagctgtcaccttcacctttttgtcctcaagagcttttaccgatgccggatcaagtccagaatccgtaattaggcggctgacatcttgcagcgaggctatatgtgaaaactcgcggttcccccatttgcttgaatcggccatcaaaatggtctggtccgatctttcaatcatccgttttttgagcagcgcctgccactcatttgaatcactcatcccgttgtgtacgtcaaatcccttacatgacagaaaggttttattgacatgataggtctcaagtgaacgctctgctaacgggccggcaaacgataatgatttttccagcaaaatgccgcctgttgaaatgactgatatgttttctttattgctgagttcaatagctgctttcattgagtttgtaatcacggtgagctcaatgtcagggagtattttcgccatgtaccaggcagttgtgcttgcatcgagaataattcggtctccgctttttacatatttggccgcttcgtgagcgatggcttttttttcgatgacattcgtgatttcccgttcagaaaaatgaatttctgattccttctgctgaatactgaccgctcctccgtggctccggctcagtttatgttctttttcaagcttttcaagatcacgtcgaatggtttcctctgtgactgaaaatatgtcacttaattcggaaacgcggatgcttgaacgcatatttactatttccactattttttgctgccgttctgctactagcatcggtaacgcccttcctcatatcgtagtccgtcttatattttttatcatagcatatttctaacgcgtaaaagcagcagggacgcctccgtctaccgtgatcatgcagcccgttgttttttcggctttggaagaagcgaagaatgcaatggcttcggcaatatcctccgggtaaatattgacgagcaatgctgtccgtttccggtaatgttcctccagctgatcgggttcaatcccgtacgccgcggctcgttcctcccgccagcttgaaccccagattgccgatccttgaagaaccgcatcaggcaaaacggagttgaccctaatgccgaattctccgccttctgcagcaatgcatcttgctaaatgggtttcaagcgccttaaccgagctgtaggcagaggcgtttttgcccgcataaaccgaatttttcgatccgacaaataccatgcttccgcctctattttggtgtttcatctgtttaaacgcttcacgggctacaaggaaatagcctgttcctaaaacattcatattaagattccattcttttagacttgtttcgtcaaatgggcttgatgtggccagcccggcattattgacgacgatatcaatgccgccataagcaagcgccgctcgttcaaaagctgattgtacgtcttcctcctttgtcacatccattttgacagccattgcccgtccttctccgtatgcatcgtttatttccccggcaattttctgtgcaccttctatattcagatcagctacgatcacgtgccctccctcagctgcaaatcggcggcatgctgcactgccgattccgccggctcccccagttatcaacgctacttttcgggaaaattctgcttccggcggggccagcgtgagtttatatagttcgagcggccaatattcgacatggtaggattcattttcatgtaaagaaacaaattgccccagagcggttgctcctttcatcacggcgatggccctccgatataaagccccgcttactttagacatggcataactttttcctgtattcaccattccgattccaggaatcaatatcacccgcggggcggattcaaagatttgatccccatcctgctgattgcgtgtaaagtatgcctgatactctgatgtaaaggtctcgactcctgacttgatcagatctgcaagcttgtgcacatcttgagtttccggattccaatcaatgtacagcggaacccgttttgtgtgaacaaggtgatccgggcatgccgcaccgatttgcgaaagtgctggcgcttggacactgtttacaaattccaagacatcgtcatgatcatcataggaaaggatcattttcttttcttcacttactgctcctctgatcacaggcatgatgcctgccaagatttgttttcttttatcctccggtagcggctgataccttttgcctccgaatacctcatgctgattgatacgatcgttaacatactgctcggcttcttgaatgatggatatcgttttttgataacatgtttcagacgtctctccccaagtgactaagccgtgtttctccattaatacaagctcggcgtggggattgtttgctacgccttcagcgatcattttagacaaagtaaatccaggacggacgtatggcacccatacaaaccgatttccgtaaatgtcttcagcgatttgttttccattatctgcacagcatatgctgataatcgcatctggatgggtatggtcaacatgtttgtatggcagaaaagcgtgtaatagcgtttcaattgaagggcggggatgtttgctgtctatcatacaatgagacaggtagtctaccatttcttcatctggcatttggtcccttttaatcagcgggcggatatcatctaatttcaaaccggtaaagttatgcgttttcattgttgccaaatccgaaccgcttccttttacccacatgacttctatttcacggcctctaaaatccttttccgttgttttcatagatgtattccccccgccccagttgcagacagtgcggtctgacccgatcagattggacctgtacaccaattcctctacacctttaggcagctgtgcagctcgctctgaatcccatatatgtttcaccatatttgatattcctccatccccttttatttgtatccgttttcattatatatgatttccgtttgtttttgaattgtttttgtttatttttgtttttaataaaaaagaaagcagcagatatgccgctttctcgtttcattatgattcaattttaaatttcttcgtaatgtcctgaagttcttccgccatgtttgccaacgtttccgctgaagagctgatttcttccatagacgcaagctgttcttccgccgaagctgcgatatcctgaatgcctgctgagctttctttcgccactgcagaaatatcttcaacagcacttgacacttcctgtgagccggctgacagttgttcaaccgtcgcgttcaagttttgcaattcgccggaaatttgggttgtcatctcatagatttgtttaaagctttccgctgtttgatccgtaatctgcaagccttctttcacttcatgattcacggattggaacattgaaagtgaggtgctgatttccctgacaatctcttgaattaatccttcaatttccttggcggagtctgctgattgtacagcaagttttctaacctcttccgcaactactgagaaacctcttccgtattctcccgctcttgccgcctcaatcgcagcatttaatgcaagcaggttggtttgatcagcaatgccattaatcacattcaagatgcttgtgatgtcttgcgattttgtttcaaggcccttcacaaccgcttccgctttttgaacggattggtcaattgttttcatctggccgactgtatgctccaccagcttttctccgctgcccgctgcctcagaggactgaatcgatgatttcgtaatggttgaagaggcctgagccacttttgaaatcccctcgttcatttgagaaagatgatttgagcttgtttccagtttctcgctttgtgcctcgttgccatctgagaactgttcgatggcaagtgtaatatgctcagttgccttgctcgtttgggctgcgcttgccgtcagctcctcagaagatgaagcaacgttttctacagacgtttgaataacgccgattacagaacgcaatgatgcagacatttcattaaagctttcgccaagctggccaaactcgtttttcgagtgaatgtcaatgacttctgtgagatctccgctgctgatttttgcagacgttgagacaagttttcttaacggcttggtgatggcacggataatatagagaatgagtatgccgccgattacaattgacacgcatagaatgataaccgcagtgttcagcaccgggcttgaagcatcttgcaattcactgacaaaatatgtgcctgcgattttccagccagtcaatttatttgtcgtaaaggccattttcttttctttgccttcgaatgtatattcaaatgagccttcttttttggaatatacttggtttgtccaatcgccggaaccggttgtccccggcttaatggtcggatgggcgatatattttttgttgcctgtcgtaataaatgcaaagccttctttaccgattttgattctctgtgatgcagtaagcacttcatccaagtttaaatcaagcgctataacccctgaaccgtcttttaattgttttgaaattgtgacaacgatatctcctgttgcttcatcagtatacggttctgagaaaacagcttgtcctttttccgcaaccgcctgtttgtaccagtcacgtcctgtcggatcgaaacctttcggaacaccgctatccggatatttataaagcttcttatcttctgaagcagcatagattgcgcctacatcgtcgttaagtgtcgtgtactgcttaaatttctctttcagtaatgttttgtttttgcctagcaatatgtctttatcgactgtctcactataataatctattgcttttactttatcttctaatttattttgcagcgtactgtttagttcttcaacatttcccttcgcactgtttatgagctctctgtctaacgcgttccaagctgattgataactgaaatatgctaaaaccccaaccggcaaaataagcactgccagaaacgcagcgattagcggtttgctgatcgatggctgtttgatccaatgtatgaattttcccattcttgttgactcctcctttaagataaatctaatatcgtcaaactaggataaaaggtttaataaaaaaactaaaaaaaacacccaagcgcaacaagcttgggtgttaaggcttattattcgattttgaatcgtttggtcatatcgcgaagctcttccgccatagacgaaagggtctctgcagacgagctgatttcttccatggaagcaagctgctcttcggctgacgccgcgatatcttgtatatgcgctgagctttcttttgaaatcgatgcaatgtgctcagacgctcccgaaacttcttcggagctggcagaaagctgctgaaccgtcgcactcatattttgcagttcgccggcgatttggtttgtcatttcagaaatgcgtttgaagctcatttctgttttatctgtgatgtcaaggcctgtctgcacctcttgattgacagattggaacatgccgagagatgtattgatttccttcacaatttcgatgattaatccttcaatctcttttgctgaatctgctgactgtactgccagttttcttacttcttccgctacaacggagaagccgcggccgtactcgcctgcgcgcgctgcttcaattgctgcgtttaaggcaagcaggttcgtctggtctgcgatgccgttgatcacacgcaaaatgtttgtaatatctttcgatttcgtttccaatccgcgtacgacttgctccgcttctttaacggacttgtcaatgacattcatttggccgacggtttgatgaacaagcttgccgccttcacttgcaatttctgtcgattgaacagatgaatcagtgatcacttcagaagcttgagccatattcgtcaacccgtcattcatttgataaatgtgctctgctgccgtttcaatgttttcgttttgtttttcattgccgttagaaaattgttcaatcgccagtgtaatgtgctctgttgccttgctcgtttgcgcagctgatgcagtgagctcctcagaggaagcggcaacattatctaccgaatcctggatggcgtgtatgagagaacgaagtgacgacgccatattgttaaagcttttgccgagctcgcccaattcatcttttgaacggatatcaatggtttccgtcaaatctccctcgctgatccgcttagaggaaccgacaagctgtttcagcggtgttgtaatcgaccgaatgatcaaagtcatgacgataatccctatgataatagctgcggccaagacaattaaagcaaggtgaaggacaggctgggctgcctcatggatttcatccaaatacatagtgccgccgatcttccatcccgtcaacttgtttgtgtcaaaggccatttttttcttatcgccgtccatggtgtattgaaaatcgcctttatcagcgttcagcatcttatcgagccagtcgccttttaattcagttcctgatttttcattaggatgagcgacaacttttttgtccttcgtcatgataaatgcgtagccttgtgtgccgatgttgacttttttggttgttttcaacagattttcaatcgtcatgttgattgcgataacgcctgaaccatcttttgtctgctgggcgattgtcacaaccatcgtatttgtcgacgcggttttataaggatctgtcacaacgacttttcctttattcgcaaccgcttttttgtaccagtcgcgttcaaccggattatagccgcttggcatcggaagatccggatagcgggtaaagtgtccttttgtgtcgcttgtataaatggattctacatccttgttaatgctgatatattgtgagaatttctctgcaatgcttgcattgctttttgcattgtatttctcttttgtcagccattcgctgaaataatcagcactgttttctttttcgccgatgctggtgttaatgatttcgtttaattgctgtacattttccaatgcgctccccatcatctgtctgtcgagtgagctgctagccgattgatacgcaaagatcgccaatatgacaaccggtatgatgaggatcgacagaaaggaaacgagaagcttccgtgtaattgatctttgttttatgagttggagtatttttttcatcattcatttctccttttttatgctacccttcatatcggctggaaatgggtaaatatatacagcaaaaaagaagaaatttaacaaaagtaactaatttcccataaataaatagtattttagacctattatttatctactttaaattgttttgtcagatcacggagttcttcagacattctttcaagcgtcagtgcagatgaactaatctcctccatggatgccagctgttcctcagctgaagcggcgatatcttggatgccatccgagctttccttagaaatggctgtgatatcatttgaagctgcggaaatttcttgagctcccgctgacagctcctcaaccgtcgcattcatgttttgcagctcggaagcaatttgattggtcatttgagatatatgtttgaagctctgtttagtttcatccgtcatgacaagccctgtttcaacttctttgtttacggactgaagcacgttcagtgatgtgtgaatttcctttacgatttcactgatcagcgattcaatttcttttgccgagtcagccgactgtaccgcgagctttctcacttcctcagcgacgactgaaaagccccggccgtattcacccgctctggccgcttcaatggcggcatttaaagccaaaagattggtttgatccgcaataccgttgatgacacgcaaaatatttgtgatatcctttgatttgatctccagccctttcaccacttgttccgctgcttttacggaatggtcaattgtgttcatttggccggctgttttctggacgagtgtctcccctttacttgacacttctgttgaatctgcggatgtttctgtaatcactgctgctgcccgcgccagctctgccaatccgtcattcatttcattaatttgttcggttgtcgtttctattttctcgctttggctttcactgccgtttgaaaattgctcgatagccatcgtaatgtgctcagtggctctgcttgtctggtctgccgatgcagtcagctcttcagacgatgaggcaacgtgttctactgagtctttgatcccgtgaatgagcgagcgaagcgagtgtgccatatgattgaagctctcgctcagaacgccgagttcatcttttgaattgatttcaatcgtttctgttagatcgccttcactaattttttcagctgatgcgacaatgcgtctcaatggctttgtgatggatcgaatcacaaaataaatcgccgtcattccagctgcgatggcaatcgccagaacgattgaagccatgatcagaaccctgcttgcagcatcgtgaatctcgtttgcatacatcgtgccgctaattttccagcctgttgtttcgcttgttgcaaatgccatttttttctttttgcctttgtacgtatattcaaagtccccgcttttatccttgtagagcttatcaacccagtccccttttagctctgttcccgctttttctccggagtaggcgatgactttcttgttttggctcaagataaaagcatagccttcttttccgatattgattcctttcgcggtagtgactaagtcatcaattttcatatcaatggcgacaacgcctgatccatccaccgtttgacgggcgatggtgacgaccatttttcctgatgaaatcgattcataaggctcagtgacaattgttttgcctttattggccattgcttctttgtaccaatctcgttccaaagcattaaagtcacttggcatgtcagcgtacggataacgtgtgaattccccgtctttgccgcttgaaaataccgcagcgacattatcattcatttggataaattgtttaaattcctgtttcagctctgttttctttttatcctgaaatttttctgctgtagcccaatcgctgaaatacgcgaggcttttttcagtcgtactgattttatcatcaatgatgtgatctaatatctgaacattttcctttgcgctttgcgtcatctgtacatcaagtgaggcaactgctgattgataagcgctaaccgaaagggcggttatcggaacaattaagatcagcaggaaagaaataataagtctccttgcaattgatgatctgcgaatagtggtgagtgtttttttcatttccttttgaaccttctttcaataatttacaaattatatcggcggatcttcctttaaattacattgaaaatgaaggtaaaaataaaaaatagttctaaattcaccggttaaactaggactttattattgtttaccatataaaaaacagcgctttgatagcgctgtttttcggtttttactcgattttaaattgtttcgtcagatcacgaagctcttctgccatctgcgcaagagtcgtcgctgaggaactgatttcttccatggaagcaagctgttcttcagctgatgcggcaatgtcctggatgctagccgagctttctttcgacacgtctgcaatgccgctgactgctgctgaaacatgctgtgaacggtctgacagctgctcgacggtggaattcatcgtctgcagcttgcccgcgatttcgtttgtcatgctgaaaatgctctggaagctttcttttgtattgtctgtgacaacaagtccggactgtacttcctgattgacctctttaaacatgtgaagagaggtttcgatttctgcgacgatttcttggatcagcttttcgatttcttttgctgaatcggctgattggacagccagcttgcgcacttcctccgctacgacagagaagccgcgtcctgactctccggcacgcgccgcttcaatggctgcgtttagtgcaagcagatttgtttggtcagcgattccgttgatgactctcaaaatgcttgtgatgtcttttgattttccttctaagcctttgacaacagcttcagcctgctgaacagattgattaatcgagttcatttgtccgactgtctgctgcacaaacttctcacccgttccggcgatttccgttgattggatagatgcctttgtaatatctgacgatgtttgtgagacttgctggagtccttcattcattaagttcagctgatgagagctggattcaaccttttcgctttgctcctcgtttccgtttgagaactgctcaatcgccatcgtaatatgctcggtggctttactcgtctgcccggcagatgccgtaagctgttcggaagatgcggccacattgttcaccgagtcctgaatagcgctgatcagagagcggagagattgtcccatttcattgaagctttccccaagctccccaagctcatcctttgaatggatttcgatcgtttcggtcagatcccccctgctgatcgttttcgatgattgaacaagacgttttaacggttttgtaatcgaacgaacgataaacagaattaaaattccgcctgccacaatggaagcaatcagcacgatcattcctgttgtcagcacagactttgaggcatccttaatttcatccatatacattgtgccggctattttccaaccagtcagttcgtttgtagtataggtcatctttttatcttcgttattaagagtatactggagttcaccgctgtcattcgcatacattttggctacccagtcgcctgaaagcttttctccagccttatggttcttgtgggcgacataggttttgttttttgttgcaatgaaagcataaccttcttttccgaccttgatttgtttcatttgttctaacaatttatcaatggtaatatccatggcgacaacgccagatccgtccttcagctcctgtgcaatggtaatgaccatgcttccgtcactcgcagccacgtaaggatctgtcacgacaatttcaccgccggccttcatcgcatcctggtaccaagggcgttgtctcgggtcgtatccgtccggcaatttctcttttggcgcttgtacgtaaatgccgttatctgcacccccataaattctggctactccttgattaatagatacatattgtgaaaatttagctttgatctcttcttgatttgatttccctttgaatgcggatcttttaagagattcactgaaaaaggtgactgctttcgctttttctcccagattatttgtaacagttgtattaaatgtatcgacactgtttttcgcatttcccataatttcctgatccagctttccgctggcgcttcggtaagagctaaattctaatataagaatagggataatgagaatcgcgataaatgagacgattaatttctttgaaatagacggtttcttcagccaattgataaaagtcttcatgtcacttgctccttcaggtttgatacagtatatatcggctgcttaaaaaagttttaaaataaaaaatggaagaagttctttttggctgtcttctgtctttttaactttcattgcccaagccctttgcatatcttataaaaaacaagggggctaaacatgattattgtatcaggacaattgctccgtccccaggatattgaaaattggcagattgatcaaaatctgaatccgctgttaaaagagatgattgagacacctgttcagtttgattatcattcaattgctgaactgatgtttgagcttaaactgcggatgaatataatagtagcggcaaagacgctgcacaaaagcggggcgaagtttgccacttttttaaaaacatacgggaatacaacgtattggagagtttcaccggagggcgccttggagctgaaatacagaatgccgccttcaaaagcgattcgggacattgctgagaacggcccgttttatgcgtttgaatgcgcaaccgcaatcgttatcatttattacttggccttaatcgatacaatcggagaagataaattcaatgccagctttgacagaattattttatatgactggcattatgagaaattgccgatatatacggaaacaggacaccactttttccttggagattgtttgtattttaagaatcctgaatttgatccgcaaaaggcgcaatggagaggcgaaaatgtgatactactgggggaagataaatattttgcccatggtcttggaatcttaaacggaaagcaaattattgataagctgaattcttttaggaaaaaaggagccttacagtcagcctaccttctgtctcaggcgaccagactggatgttccgtctcttttccgcatcgtccgctaaaaagccccatcgcctattttccggacgatggggtttcaaatgcctttcgttttcgatagaagggggctgtgccgaaatattggttcgcagcccactccattttttcaaggtcatttcttgtcacgattggatcctggctgctccatttgataaagcggacaaaatagtagcctttgataggaaccattgtaacttttgagtgaggccagccttcaaatacaaactcaattttccctctttttttataagaatattgaagaatgttcatatctgtcacctcagtttatcaagttacgttcggcaaagctcggtacgtttacatccattgattgactatccctcatgcaggctttcctgaaaacaaagggtgaggcgcgtgtctctttccctcgctttttatttcgcatatggacgaatgccaagcgcgccttcattcgataaagcggcagccggggcgggtgtgacaagccctccggctatcggcgtttgttcagcgatcatgcttttgtcaaaaaaacagcctattatcccatcattttgatatagcatgtccgggtgcgaggtccgtcaaattcgcagaaataaatgccctgccacgttccaagaatgagccggccgttttccactatgacatgctgtgaagctccgactgtactcgacttcatgtgtgcagctgtattgccctccatatggcggtccagcttatgttcccacggatatacctcatcaaaccttctgagcatatcttttttgacgtccggatcggcattttcattaattgtaatacccgcagtcgtatgcggacagtaaattagcgctgcgccgctcgttatacctgtttcttgaagaaacgtttccacctcacgggtgatatcaatcatttcatctcgtttggtcgttttgatttgcagtgttttcagcatttgtttctcctttcgtttgtccgctctcattgcttaattctttctgtgttctttttttcctgttaaaccgctctcataaacctgatacaacaaaaaaactccagtctaaggctggagattagcgccatagatatattcttgcttcatacggctttaagagtgctgatgtcatatgcttgtgcggctctgcttcaatatttgacaagacgagtgcatctgatgacaatggcaatccagagtgcttgaacaacgccggtgttcctgtcagattggccgcaatcagtgcagtatggctctcgtttttccgaagatatgcaaagatttgctgatcttccggtaaaatgagctcgtatgtcccgttaataaaaacatcatatgtttggcgcagcttgatcaagcttttataaaaatggtaaacggatgttttatcatttttttgcgcctcggcattcagccatttgtaattctcattgattccgatccacggtttggcctcagaaaatccggcgtatggacctgcattccattgcatcggcgttcttgaattgtctcttccctttttccagacaatcttcatcacatcctcgtgtgatgtgcctttcgccgtttttgtttcatacaggcgtttcattgcgacatcatcatagtcatcaatagatggaaaagccacgttcgtcatcccgagttcctgtccctgataaataaacggtgtgcctttcatgagaaaataaacagcggaaagcgcttttgcactttctttcaggtacactccgtcgtctccccacacagaaactgaacggggctggtcgtgattctccataaacaaagcattccagccgatcccttccagattgtcctgccagtcagttaaaattcgtttaaatgcaacgatatcaatactttcattgatctctacatcccacaggccgagatgctcaaattgaaaaatcatgctgaatatgccgtttttttctccagcccaatcagctgcttcttttgcagcgacgccgtttgcttcaccaactgtcataatcggatagcgggaaaatgtgttttccttcagttctgttaacaaatccataatgccgtcagcattcatatgataaggaaaggaagggacatagtccaatccctttggattcggcatgtcgggaagcccttcttttttcttaatatgcgtaatggcatccacccgaaatccgtcaattcctttagcaagccaccaattgatcatgtcataaacggcattcctcaccttttcattttcccaattcaaatcaggctgttttttatcaaaaaggtgcagataatactggcttgtcttttgatcatactcccaagccggcccgccgaaaatgctttcccaattgttgggcgtttttccgtttttgccgtctttccaaatataccagtcgcgctttttcgagtgtatggatgaacgggattctatgaaccatggatgttcgtcgcttgtgtggttcacaacgagatccatgatcagcttcatatccagatcatgaatgtcaccaagcagctcgtcaaaatcttccatcgtgccaaactcgcttaatatgttttgataatccctgatatcatagccattatcagcattcggtgaatcatacagcgggcaaatccatatgacgtcagcgcccagctcttttatgtaagaaagcttggatctgattccttgaatatccccgattccgtcgccatttgaatctttaaaactgcggggtaaatttggtaaactacggcttccttccaccaagcctttttcatacagccactccttcccagtgtaccgttcttatatatcctatgtagaaaaaggtctttacagcattgctttttaagaaatgacttgatgacacaaaaaacagccgtttgttccccggctgttttttatcaaaaatcagttttttttatttctacaaaacggatgtgatgatcttcggcgtcgaggattttaaattcacagccctccgcgtgtatcacatcccctgctttcagctccattttttgcgttagaagccagcctgcaatcgtatcaatttcttcattttcaatcgcaatgtcgagaaggtcattcacttcgtctattagcgcttttccatccatcacataatggtgctcgccctttttcaggatgtgcggtgtttcatcctgatcatactcatcgcggatttccccgacgatttcctcgataatatcctctacagtgacaagccccgccgttcccccgtattcatctacgagaatcgccatgtgaatccgctccttctgcatgcggattaaaagctgctgaacaggaatgctttcaatgaccctgataacgggcctcatgatttgctccagctttatcggctggccgagaaaataagctttaaacatatctttgctgttgatgatccctaaaatatgatccttgtcatctttgatgacagggtagcgtgtataccgttcattaatgatgtgatgaattgcctcttcaagcgactgctccagagagataactgcaatttctgtccgcggaatcataatctctctcgctacccggttgtcaaattcaaaaatcttatttacataacggaattcagactgattgatttctcccttttcatagctttctgaaaggatcagtcttagttcctcctcgctgatgacaacctgatgctcctttactgaatgaaagccaaacaatttcacaagaaaacttgcagagccgtttaatgctttaataaacgggtacgtgattttataaaaccagatcagcggctttgcaatccataagcttacagcttcagctttttgaatagaaaccgttttcggagcaagctcccccatcaccacatgcaaaaaagtgacgatgataaatgcaactacaaatgtgacaatgtggttaaacggttccggcatgcctgtcattgtaaataagggatgaagaaaacgttcaaatgtaggttcaccaagccatccaaggccgagggcagtaatcgtaatcccgagctggcaggctgataaatactcgtcaagattggagatgattttatgtgcggctagcgctcggctgtcaccgctttcgatgagctgattgatttttgaacctctgattttgacgatcgcaaattccgctgcaacgaaaacagccgtaatgccaatcaaaacaaaaatggcgatcaattgtaaaataagcaaaaaaagcccttaccataaatggtaaggggccacctccttaacgttaattctcatcacgaccgtttaagaaaatcatcacaaaacgaagtagttcaaacagggaaaccagggcggcggccacatacgttaaggcagcagcgctcagcactttatttaccccattttcttcattgtttcggatgaatccttctgacacaataatctgcttggcgcgtgaacttgcattgaattcgacaggcaatgtaatcagctggaaaaagactgccgctgaaaacagtatgatgccaagcccgatcaaattcaggctgccgagaagcatgcctcctaagaaaagcaaaggagctacaccggatgcaaaattcacgactgggaagattttatgtctcagcacaagcgcaccatatgactcctgatgctgcaaggcatgtccgacttcatgggaagctacggatatggcggaaattgagcggccgtaatagaccggctcagataaacgcaccacccgtcttgtcgggtcgtaatggtctgttaaagtgcctcttaccggttcgaccggcacgtcgtaaagaccgtttatatctaaaatccgtcttgccgtttctgcccctgtacgtccgcttgaggcttccacttttgaatatttttcaaagttgctctttactttaaattgtgcccaaaacgacaatcccaatgcggctattgttaaaaatataaacagcattttttcatcatcctttttacatgatcatttctctattacgattattttaatgagttttctttcccgtgtacagaaatgcgctttttcttccggcttggagcacacaatccaatcagcaaaaagaacaggcctgctgaaaacaaataaaaggcgaaactgccggccagttctttcagaaaatgaagccaggagaagctgccggagaagtgattatatgaattcaaatcgaaaataaacaaaatcaccgcggatgccgccagctgcgtaccgatcaaaaccacgatcgttctttgaaagatcgtcatctttttcatcctttttgttttagtttatggagaaatccggttttatatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctttataatgaatcggaaattgatgaaccgcttattcagcttgatgatgatacagccgagttaatgaagcaggcccgagatatgtacggccaggaaaagctaaatgaaaaactaaatacaattattaaacagattttatccatctcagtatctgaagaaggagaaaaagaatgaaatcaaatcggatatttatttcatggctcaggtggccgttatttatccgaatcggggttattattttatgtctgattcttttgttcggccaaatcatttatatacttgagcctaagcagttcacttcggtattcgaaggcatttggtgggctgtcgttacggtttcgacagtcggttatggagactatgtgccgcacacgccgctgggacaggcagccggaatactgctgattttgagcggagcaagctttgtcacagcatatttcgctacgttatcagcggccgcattcagcagacagcatcgctacatcgaaggaaaagttgcttacaaaggccgggaccacatcattctgatcgggtggaatgaaaaaacaaatcggcttctgaaggaccttcagcttgccgccccttccaaaacggtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgcttactcttttatctgttaaagggcttaatccccttgcttactgcatcgtcgagattttgactgaccgttttgtcaccaatgcggagcgggcaggtgcaaaccaaatcatcggaacttcagaatttatcagccgggcgatgctgcagcattaccaagtcaagttacggccgtctaaacagcagaacggaatcaagctgacacttgatcagcatgtggagcttcttgctgttcctgacgaactaaagggagcggcttacaaaacctgtgttctctatttccttgatcacaacacaacaattataggcgtacaaaaagaggaggggccgatgatttcccctcctcttacatacaaggtgctcgaaacagatcaattccttgccatctagtgtaacagaacatcctccaattctttcacgagagaggcgccgatatccaaaaatgccggatcaatttccgcgtcccgcctttccggttcggaaaattgattaaacagtgattggaaaggccctccctcggcgtgatcgtcaacatccgcctgaaacacctgtctcagcataaacggcgttccgatccggacggccgcccctcgttcatcgagactgccctgtaccgcattgacgggaattcttaaaaataaatagccgtctctatcatcaattttataatcaaagtagccatgatcgtattcccagccgccgtttatcacataaccgagcggcttcatcacttgttccagttcttgaagcagaaaagactgcccatctatcgcggaaggtattggtatcatcagaatgccccttttttcacttatcctgtcccgccgaacaagacttcattcagaggcgcctacatggaaatcgttgtttctttcgcgcggccaacagaaaagaaagcgcattcaattaagaagtaaacagtcattgccgctgcaagccatacagctgaatcccaagacacataaacaaccgttgcatagagtcctaatttagtgaaaagagtatgggttcgttttaaatgcaaaatccgatgtaccgcatcggtaaaaagggcaagcggcaaaccaatgagaagaaaggcgtggatgaaaaaatgtgacagcgtgccgccaaagcttgaagaaaactctgtatacacggcatcaaaggagataaggaaacttaaaatagctgcagaaaaaccggcaatgatgagatgtttaaccaattgtttcatgaacatcagcacctttctgattttataaaaagccgaccggcaaatgccagtcagctttctcacattaatcttccagacgtttttcaagctctgcttttttctcttcaaagccaggtttgccgagtaacgcaaacatattgactttatacgcttctacaccaggctggtcaaacggattgacgccaaggaggtaaccgctcatcgcgcaggctttttcgaagaaatatacaaggtatccaaaagtatatgcattcagctcaggaatgttaacgattaagttcggaacatttccgtctgtatgggcaagcatcgtgccttggaatgcttttttgttaacgaaatcaacagttttaccggctaaatagttcaagccgtcaagatcgttatccgcttcctcaattgtcagttcatgtttaggtttctctacgttcaggaccgtttcgaataaatctctgcggccttcttgtacatactggcctaaagaatgaaggtctgttgaatagttcgctgaagaaggataaatgcccttctcatctttcccttcgctttctccgaacagctgcttccaccattccgcaaagtattgaagcgccggttcgtagttgatgagcatttcaattgttttgcccttattataaaggacattgcgaacaaccgcatattggtatgctgggttatcttccagttcagatgttgcaaaatctttgctcgcatccagggcgcctttcatcatgtcatcaatgttgacgccgctgacagcaatcggcaagagacctacagctgttaaaactgaataacggccgccgacatcgtcaggaataacaaatgattcgaagccttcttcgttagaaagcgtttttaatgcgccgcgctctttatcagttgttgcataaatccgcgctttcgcttcttctttaccgtatttctcttcaagaagcttgcggaaaatacggaaagcgattgcaggttcagttgtcgtacctgatttagaaatcacattaatagagaagtcaacatcttcaagaagatccatgacgtctctcatataagatgaactgatgttgttcccgataaaaatgacttgcggattaccgcgttttgcttttggcaaagtgttataaaacgcgtgattcagcgcttcaatcgctgcccgcgctccaagataagaaccgccaatgccgacaacaagcaagacatcagagtcagatttgattttttccgcgctttttttgatgcgcgcgaattcttctttatcataatgttcagggaggtccacccagcctagaaaatcgctgcccgcgcctgttttttcatggatattatggtgtgctgtttttacaaagtcccgcagatatgtaagttcatgttcgttgaagaaagtcaacgcttttgagtagtcaaagcgtacatgcgtcattgcttgtccctccataacggtataatgttttcatctttcactttatatgaacttatctgtgaaatcaagtcaagaagaaagggcggaatgactggattccgccctttgagtttatagagacgcgcgaaggatggcaagcacgtcatctttgttcagtttttggaagttgccgaagccgccgtgttccatttccttggctgcgatatcagcaatcagctcaagcttttcttctccaatattgtaatcagcaagacgagaaggcgcaccgaggcttgtccagaacgcagacagtttatcgattccttcaagcgcaatttctttatctgttttgccttcagtatcaatgtcaaacatgttgagcatgaggtttttgaagcggcctacatttgtatcaagcgtatatctcatccagttcgggaacagtatcgccaaaccgcccgcatgcggaatatcatacacagctgaaacggcgtgttccattgtatgagaagcccagtcaccaaagtagcccatttggagcgtgccgtttaaagcgattgtaccagcatacaaaatcgtttcacgaagctcgtagttttccagatcttcaagaagcttaggagctgtttcgatgaccgtctgcaaaacagcaaagcacattctatcctgaagcggcgtgttttcaacattgtggaagtattgttcgaatacgtggctcatcatgtcaaccatgccgtatactgtttgattttccggaaccgtgaacgtattttcagggtctaaaatagagaaacgcggatgagtgacattgctgccccatacaaatttctcgtttgtttcccagtttgtaatcacggaatcagggttcatttcagaccctgtcgcagcaagcgttaaaacagttccaaacggcagcgcatcctccgctgttacttttttgctgaaaatatcccaagcgtcgccatcgtatttgacgccagctgcgattgcctttgtacagtcaatcacactgcctccgccgacagcaagcagaaaatcaatgttatgctctctgcaaaggtctatgcctttttccactgtcgcaagacgcgggttcggctctacacctgacagctcatgaacaacagcgccctcttcttttaaaatgcctgtgacttgatcataaaggccgttgcgtttaatgctgccgcccccgtaaacaagcagtacattcttgccgtatcgtttgaattcttttcttaattgttcaagctgaccttttccaaaaatcagctttgtcggattataataagtgaaattttccatagtaaaacctccaaatgatgctggtgaaaaacagattttccattgtaacataagttgacaaaaagaaaaagggaagcagccaaacggctatttcccctttttttatagagatgctttcaaaattgacagcacatcttctttgttgagtgatttaaattggccgaatgtaccgttagccattgccttgtcagcaattgtgtcaagctgctcatcattaatatcataatcagcaagacggttcggagcgccaaggcttgtccagaatgcggacagcttatcgataccttcaagggcaatttcttcatccgttttacctgcttcttcaacatcaaacacgcgaactgcaagctgtttcatgcgggcagggttttcagacaatgtgtgtctcatccagttcgggaacaaaattgccagtccgccggcatgcggaatatcataaacggctgatactgcatgttcaatattatgagtagcccaatcccctcttgcccccatagaaagcatgccgtttaatgcgattgttcctgtgtacaggatcgtctcacgcaattcgtaattttcgagatcattaatcagcttaggtgctgtttcaatgactgtacgcagaagtgattcacacatgcgatcctgatacggcgtgtttgatacatgatggaagtattgttcgaatacgtggctcatcatgtcaaccatcccgtagatcgtgtggtttttaggtacggtgaatgtattcaccggatcaagaatcgagaatttagggaatacgagcgggctgccccagccgtatttttcttttgtttcccagtttgtaataacagatcctgagttcatttctgaaccagtcgcagcgagagtcaataccgttccgaatggcaaagcatcttttggctgatgctttttcgtaacgatatcccacgcatcaccatcatacttcgctcctgcggcaatcgcttttgtacagtcgattacgcttccgcctccgacagccagcaagaaatcaatgttttgttctttacagatggcaacacctttattaacagttgacacacgaggattcggttccacacctgctaattcatgcacggtcgctccggctttattcagctgttcaatcacttgatcatacaggccgctgcgtttaatgctgccgcctccgtacacaagcaatacgttttttccgtaaggtttgagttcctccggaagtctttccacttcgccgcgcccgaaaattaatttggtcggattccagtatgtaaagttttgcatgacatctcctccttagattttttattatgcagaatgtcctcaccacatgtaaagcaatcagctctcaccggtcagcataccagatggttttattttgcatgtcgctgggaaagaagctgatataagcgagggcaggccagcttccctcatatggagaatgcatgtatagattctccaatatgtcacaatctataactgttttaataattcatggaggaggttgcaaaacatgagtaccattcaaagaatttgtcttgtattaaccatcattggcgccattaactggggactgatcggatttttccaatttgacttagtagcggctatcttcggcggccaagggtcagctctttcccgaatcatttacggacttgtcggaatcgccggcttaatcaacctcggtctgctatttaagccaaacgaggaaagatcacgtgaagaagcagcaaatcctgaaatgcgataggatatcaatcacgctgaaataggattttgtattaaatcaaaagcaccgaacattcctgtccggtgctttttttcatgcttattttttgataaggtctttgcggttggacatttcgatccactcttcaagcttatcttttaatgtgttgaaaccttgtggtgtagaagcttcttcgcttacttgagcagctttaggttttcttggtttgctttcttttttctcaggcgcagcttgtgtcgcacgaattgaaaggctgattttgcctttttcttcatcaacagcaagtacttttacttgtacttcgtcgccaactgaaaggtgctcgttgatatcttttacgaaaccgtgagtcacttcagaaatgtgtactaaaccttgagtttcttcatctaatgcaacaaacgcaccatacgcttgtaatcctgtaactttaccagtgtaaacactgcccacttcaaattttgctgccattcataacaactcctaagttaaattaaatatctgtttatacgcaatttaaaattatatcacacatgtcttatttccgcaaagaaaactttttataaaaaatcaggtttatgcacagcaaaaagggggtaaactgaaaataccaaaggctttctagtattcccccttttattggatgcgaacaaaaggttcgtatctttttttatgttgttttgtgcaggaagcgtttcattctgactaacgcttcttgaagctgttcaatcgaggttgcgtatgaacaacggatatatccctcaccgctcggaccaaacacacttccaggaacaactgccactttttcctgcgtcagaagctcctcggcaaactgttctgaactcattcccgtgcttttaatagatggaaaagcatagaaagcgccgcccggatgatgacagctgaggccgatttcattgagcgattctacaaacagattccgtcttcttcgatagctttttttcattttttctacgtcttccatgccgttcttcaggccttcaagggcggcaaactgcgccattgcgggcgcgcacatcatcgcatactgatgaattttaagcatggcatcccgaagcaaggatggtgccgcggcaaaaccgagcctccagcccgtcattgcaaatgcttttgaaaagcctgagatgactaccgtccgttccttcattcccggtaatgccgctatacttgtaaattcctcatcatatgtcagctccgcgtagatctcgtcggctaaaacgatgacatcatgttttttggcaaactcagcaatctcattcagctcttccttcgaataaaccgaacctgtcggattcgatggtgagcagatgagaatggcctttgttttttcagtgactgccgcttcaaaatcagcagccgttgctttaaatcctttgtctgccgttgtatgaacgtgaaccgggataccgcctgccaaagaaacaagcgcatcgtacgccacaaaacacggctcaggaatgatgacttcctcacctggattcacaatggcgcggatcgcgatatccaaagcctgacttgcccccactgtcacaatcagctcattatctggcgagtagctaaggtcaaacctgttgctcaaataacggctgatttcctcccgcaatgagtataaacccgcatttgccgtgtatgacgtatatccttgttcaagagagagaatgcttgcttcgcggacattccacgcggtgacaaaatcaggctcgccgacgcctaaagaaatgacgccttccatcgttgccgccaaatcaaagaatttgcggatgccggatggttttatttgttgtacatagtctgataaatacgaagtcatttacggtgacaccacgattcttttgtcgtcgtctcctgtttcaaacactttgccgtcatgcttgtattttttcaggataaaatgggttgtcgtagatacaactgaatcaagcgttgacagtttatccgaaacaaaacgcgctacgtcagacatcgaattgccgcgaatcacgacagacaaatcgtacacgcctgacatcaggtaaactgattcaacctcttggaatcggtaaatccgttccgccacttcatcaaaaccgacgccccgtttcggcgttactttgacgtcgatcatggccgtaacgccctcatgtccgtctacttttcgccaatcaatcatagcggaataatcgataataaccttttctttctccagtttgtcaataattgtttttacttcatttacagggatgcccgccatctttgcgattgtttctaaatcggcgcggctgttttcgtctaaaatttctaatatttctgtttctttttctgtcaatttcatttgattcacacctttgctatgtcaagaaatctcatgacattatatcacgttttttgacgaatgctaagaaaaaaacgaggagaaacttccgctggaattgacaatttcagggcataatacaaccatcaaaaaaaaggagtgacacagaatggaggcggtttcaccaataaggcggtttacggtcgatggagtcaatgtatactacgaacattatcaaaatcccggcaggcaaacgctggtttgcgtacacggttttttatcatctgcattcagcttcagaaaagtaattcctctccttcgggacaagtacgacatcatcgcgcttgatttgcctcctttcggccaatctgaaaaatcaagaacgtttatctatacctatcaaaaccttgctaagcttgtcattgggattttggagcacttgcaagtgaaacaggctgtgcttgtcgggcattctatgggcgggcagatatcgctgtctgctgctctccaaaaacctgagcttttttcaaaggttgtgctgctttgcagttcagggtatttaaaacgttcacacccgacgattattttcgggacccatatcccgtattttcatctttacatcaaacgctggctctcgaaagaaggcgtgatgaaaaatttattaaatgtggtgcatgacaaatcgctgattgatgaggagatgattgacggctatggcagaccgtttcaggacgagcagattttcaaagccatgacaaggtttatccgccacagagaaggagatttagaacccgagcaattgaagaatatgaacaagcctgctctattgatttggggcgaggaggatcgaattgtcccaatggagatcggtaaacggctgcacgcagatttgcctaattccgtgctgtactcacttggccagaccggacatctggtgcctgaagaacggcctgaacttatttctgaacacattgctgattttatcaaataacaaaaaaaccggtgctgaaccggttttttaaggcgtgcaggagctgctgtttttaatgaataaaagctggcctgccacttcccggcagctggcgatcggcagcgtttgttcaaaagaagtttcaaatatttgctgaatgcttttcgccagcaagtcgggatcgttttcatcatagactgcctgcacgacatcaacagcctccgtttcgtaaaactcttctccatatttaaacgggtcccatttggcaatgatcttaatcatttccctgaccgcttgactttcttccatattcatcaccgcttataataaaatttgcagttctatcttatcatagtgaagcttagaagaataaacatacatgagggggtaacagaatgaactttgataaacgagaagaacgccttggcacccaatcggtcaaatgggataaaacaggcgaattatttggcgtgacagacgccctcccgatgtgggtggcagatatggattttcgcgccccggaagcgataactgaagcgttaaaagagcgtcttgaccacggtatttttggttatacaactccagatcaaaaaacgaaggatgctgtgtgcggatggttgcaaaacaggcacggctggaaggtaaatccggaaagcatcacattcagccccggcgttgtaacagctttgagcatggcggtacaagcttttacggagccgggcgatcaagtagttgttcagcctccagtttatacgcctttttaccatatggtggagaaaaacggccggcacattttacataatccgctgctagaaaaagatggcgcttatgcaatggattttgaagatttggagacgaagcttagtgacccaagcgttacattgtttattttatgcaatcctcataacccttctgggcgttcatggggccgggaagatttactgaagctaggcgaattgtgccttgagcatggcgtcacagttgtatcggatgaaatccattccgatttaatgctgtacggacataaacacacgccgttcgcttcgctctctgacgatttcgctgatatttccgtgacatgtgctgctccaagcaaaacatttaatatcgccggattgcaggcttcagcgatcattattccggatcgcctgaagcgcgccaagttttccgcaagccttcagcgaaatggtttaggcggactgaacgcgtttgccgtcactgcaatcgaagccgcgtattcaaaaggcggaccgtggcttgatgaattgatctcttacattgagaaaaacatgaacgaagcggaagcctttttgagcaccgagctgccaaaggtcaaaatgatgaagccggatgcatcatacttgatttggctcgacttcagcgcttacggcttatccgatgcagagcttcagcaaagaatgctaaaaaaaggaaaagttattttagagcccgggacgaaatacgggcctggcggagaaggatttatgcgcctgaacgcgggatgctctcttgcaaccctgcaggacggtctgcgccgcatcaaagccgcattatcgtaaatatagctgtaaacgcctttacgtcttcatttgtaaaggcgttcttaataaaggaattttatattttacttctaatatttagtgttataatagattcatattttatacgaaaggatttcacacgaatggaaattctaaaagactatcttctgcacatctgctttattttgtttcctattcttctttaccaagtgttttggcttggaaaacctgcgattcttgtgccaaaaataaacagcggtttggtcacgctcttcgcctgcggcgcctccgttttatgcattactttcccgattcatgaaatggactacatacaatacggccttcagatgattcccgttatcatttgtttattttacattagtaccgcttccggacttacagtcgccgcatctgtcctatgttttgaactgcttttttacgaaccttccgcaatgtttgttttcactttgctgccttttcttatcattatcccaatcttatttcagaaaaaatggccattcatgtccaaagcgaaaaaactgctgctgtctttattgatcagctgcgtggagattttcctatttttcgcctcaagctggattctttccgccttgaatattttaaattttcaaaaatcaggaattttcgtttacgaggcggcagtctcagggcttttccgctccagtgttcttctattaagcatctatattatcgaaagcatcgccgaaaatatcgccctgcgctcacagcttatccattctgaaaaaatgacgattgtgagtgaactggcagcgagtgtcgcccatgaggtcaggaatccgctgacagttgtccgcgggtttgtccagctgctttttaatgatgaaaccctacaaaacaagtcgagtgcagattacaaaaagcttgtactgtcagagcttgaccgggcgcaaggcattattacaaactatctcgatatggccaaacagcaattatacgaaaaagaggtttttgacctatcagcccttatcaaagagacaagctcccttatggtgtcgtacgccaattacaagtcagtaaccgtcgaggctgaaacagaaccggaccttttgatatacggagacgcaacaaagctgaagcaggctgtcatcaacctgatgaaaaacagtattgaagcggttcctcacgggaagggtgtgatccacatatcagccaaaagaaacggccatacgatcatgattaacatcacagacaatggggtcgggatgacagaccatcaaatgcaaaaactcggcgaaccttattattccttaaaaacgaacggaacgggactcggcctcaccgtaaccttttccattattgaacatcatcacgggaccatttcatttaacagcagcttccaaaaaggcactacggtgaccattaagcttcccgctgatcttcctcactagcaaatcgattggaactttaatagaatgaatgcgaggtgatgacagatgagcacgtttgagacaggctctatcgttaaaggattttacaaaacaggtgtatacataggagaaatcacggcttgcaggccgcagcactatttagtgaaagtgaaagcggttcttacccatccctctcaaggagaccttcatcatccaaaacaggcggatgtgccattttttcatgagagaaaagcgctcgcatatggtgaacagaccaatatcccccaccatatggtgaagccttatgacggtgaagtgccggattataccgaatctctgcgggaggcgacagcacagctgagagccaaattgaatgaggatggttcggagtgggcaaagcgctcccttcataatctggacattttagaaaaagaatattttaaccggccataacccagtctgacaaaagattgggtttttttaagttgcgcgtttaaacagttcggataaatcgattctttcgccgattgtcggcggttttggcttttcgagatactgcttatcctgctcaacaagcttaaaaagcttatatgctgtgagggcgtcatcaagcgctttatgatgggtgccggttccggtatctccatactcctcggcagctttccataaacccgtcagtgtccggtctccaaaaaagtttttgtattcaagcgataaatctctcatttctcccttaaacgggaaaggaatatggttaaacatacagttttgcttcagcactttcatgtccatgtttccccacgtaataatcgtgctgttcttctcaggatcaagctcgtttagtttgcggatgaaatcctcgaacctcatcccctcgtctacctgcttttgggttatttttaaaaacgatttgcagcgttttgtcagcttcgggaattttttcggtctgatatagctcgaaaacgtctcaactacttcatcatcaaccgactttacaattccggcttcaatgatttctgggaagaaattttgcgggctgtactttccatcaggcattgtaaattcgaaatcaataatgagtaagctgtttgtcgtcacctttttacacctgcctttcctccgatcagaaaatgctatctttatagtatatcaattccccttctcgacatttcttcattttctaaaaataatgaattttcccagccgcttcgtttcttttaaattgtgaatcgtttctttataattagtaaggaacccgaaataataagaaggtgatgttatttctatccgtaagaaaaactttgtcattgtgtggctggcgaacttttttgtctccgctagcacaacgatgatcgttccctttctctccttatacattgagacgctcagctctttttcaaacggctttgtgcaaaggtggagcggctatgtgttcggcattacatttctcatggcgtttttggtatccccgttttggggacggttcggagacaaacgcggatacaagaaaatccttatggcaaccggaacgggcattgcccttagcattttcttcatgggctttgttacatcggtgtaccaattgttttttctgcgtatggcaatgggtcttgtaaccggattcatcccgacatctcttgcgatgatttcggcacagactccgaagagctcagccggcaaaacgcttggcacgctgcaaatggggcaagtgtccggaagcttgttcggcccgcttttgggaggcatgcttgctgatcatttcggctttacgtataccttttttatcacatcctttgtgattttctcgtctgttcttctcgtgttatttggtgtcaaagaaaagcctcttgcagagaaaacagccaaacgtacgtcttactcgagaaaagaagtgctctcctatatttttcaccatccggcgctgtgggtcatgatgctgttaaccatgctgattcaaacaggcaatttcagtatccagcccctgctcgctttatatgtaaatgagctgcacggacctgtcaatcttgcctttttctccggcatggcattttcagcaacggggctcggaagtttgctgctggctagaaaatggggtgatctgggcgaccgctacggccaccgccgcattttaatcggacttttgctcgccgcctctttcttttttattccgcaggcgctcgcgtcctcactcagcgtgctccttgttttcagatttttattcggaatggcgatgggcggtttgctgccatgcattacggcagcgatccgcgttcaggcccccggcagcattcaaggtgaagttctcggctacaatgtcagctttcgctttttaggaaacgtgctcgggcctctgctcggcggaatcatatcgagccattttaccatttcggccaccttttacgtcacggcgtttctctttttcgccggcgcctgcatgctttggatcatgcagaaacttcggaaagattcttatgccaaagcaagctgattccgagaaaaaactgaggaatcttctaaatttaaccttctcgtaatctcaaaagaatggtacgatatggctagaatttaggagaaaagagagtgaccatgttacgaaaaataatcggatggattttgctcctttgcataatcccattgtttgcatttacagttatcgcttccggaaaagaagtaaaacaaatgaagtccctggatcaggtgcttgataaaaatattaatctgaaagatatcagccttgttcagaacagctacatgtatgacagggacggctcccttgtctcggaaatcgtcagcgaccacgaaaaccgtgtgctcgttccatttaacaagattcccgaggaagtcaaacagattttcttaacatctgaggaccgccatttttacgagcataaaggctttgactttatgggaatggtgcgggctactgcttctaacgtaaaagacaagaaaattgaccagggtgccagcaccatcacacagcagctttcaagaaacttgtatttgagccacgaacgctccttcagccgcaagctgacagagctcgcgtattcctatcagctcgagaaaaaatatacgaaaaatgaaattcttgaagcttacttaaataccatttattttaacaatggtgtttatggcgtcggttcagcggctgaattctatttcagcaaaccgctgaaatctctcacagtgggagaaatggcttttatctgtgctatacctaataaccctacattatatgatcctctcaagcattttgactacacgaaaagccgtcaagaacgtttgcttaaagggctaaaagatgccggggtcattacggacaaagagctgaaaaaagccgtaaaacaaaaaatcaaactggatgttgaaaaaagagaagacaaatatcctgactacgtttcctacgtcaatgatgaattcactcagctggtgtctgaatcagaaggctttgataaacgccttcaaaaagcatcaggaaaacaaaaagaaaagatcgaaaacgagctgtccgcaagagtcagcacgctgatgaaagacggcgtgaaaatttatactgcacttgatccgtacatgcaaaatcaagttgtggcacaaatgaattccaagctcccgtatgcggacgtacagggcggagcggctgtgattaatcaccagacgcatcaaatcatcgctctatccggcgggaaaaactatcaaaaatatgactttaaccgcgcctaccaggcgtacaggcagccgggttcatccattaagccgcttcttgattacggcccttatattgaacagaccggcgcgacaggaagcagcaccattgatgccagcaagttttgcagcaaagactactgtccgcaaaactacaataaccgcacttacggcacagtgacgcttgatacggcgtttaaaaattcatataatacaccggctattagaatgctcgaccgcgtcggcatccaaaaggcattcagttatattgagccgtatcattttgccaaactggtcgacagtgactatcttcttccggcggcgcttggcggatttacaaacggcatgacgcctcttgagatgacaaaggcttatacgacattcggcaacagcggaagctatacgccgagccatgcgattacaaaggtgacagaccttaaaggaaaaacactttataaatggaatgataaagcgactcaaatattcagcgtccgcacgaacatgcagctgaaaaaactgatgtcttccgttgtgaaaagcggaacagggaaaaaagcatatttcaatgcgccttacatcggcggtaaaaccggaacatcaaatgattatcacgatatgtggtttgtcggcctgactgatacgtatacaatgggtgtctgggtcggaaaggatacaccgaccagcgttgaatatcttcacagcatcagccctcagctttccatctggaaaggaacgctgcaagctgcttattaaaggatcggaggggatatggagtgacttcagaacaaattccaaatcgcgttttgctgtttgacggtgtctgcaatttatgcaatggcgccgtgcaatttatcattaaacgtgatccggacggattgatttctttcacatcgctgcagtcggaaacaggacagagcctgctgaaaaaaagcgggcttccgactgatcggtttgacagctttgtctttattgaagacggccaagtgcacacaaagtcaactgcagccattaaggttttcaggcatctgcgaggcccatggcggctcttcgtcctgtttttcgcagtaccgaagcctgtcagagatatggtctattctttcattgccaacaaccgctataagtggtttggcaaaaaaaatgaatgtatgctcccctccccttctattaaaaaaagatttttaccgtaaataaaaaatggctaggaagctagccatcacagattgttgacaaaatcctaaaacggcttcgttttaggattttgtcatctattcagcgtgattgaaaacttttgaagttgtgaaacggcggaaacctgagaatctagccgccgtttcattgcgtacagagcacgaagcgcaaatctgaccaccaaacgctgaaatggctagcttacacaggtaagctagccattatgctattataaagcttgataaatatgaacagaataccgataacaaaggtaaaccaaaacagcagttccaatagaatgaatccaactaatgacatgagagaaagcgtcgaataaatccggtatacggtaaacacaaagtaagcgagcgtgacgaccgcaaaccagatcacaatccaaatgacattttgcaagagcacaaaggataaaatcccgccgcccaaataaatcatggaacccattctgagttttttcaggttgttcccttccggatcattagcaaaaaacagcaatgacagctcggtcacggtatttgcaattaatttcagagcggacagaaccataaaatataaaagtgcaaaggcagcaaataacgcaagcctgattcctttctctgaaaaataatcgagcattccatcatacattccaaatgaagacagcatcttcaacgcataaagtgaagttgagatggataaggacgaactaaaaagcaggatcgcaatcagcggaaaatatcctgtcaaataagtatttttcatataaaaaagtccctttctataatctacctcatttattatggaggacttaaaacacattgacaagataaattattccattttttctcctttttacgaattacggtcccaaatcttcacaaagcagcattttgagagtaaagtagtacgcaggaatcataaaacgtaaggaagttttatatgaaaaaaacattaaaactgcaaaccagactcaccatatttgtttgtatcgttgtattaatcgcattgctcattacgttttttacagtcggtgcccaaaccaccaaacggattagagatcaggaaaaggccactgcgctgcagactgctgaaatggtagctgaggcgccgatgacagccgctgctttagaaaacgggaaaaaacaaaaggaactgcagagctacacaaagcgggttcagaaaatcaccggcacggaatttgttgtcgtcatggatatgagcggtatccgcaaaactcatcctgacccgagcaaaatcggaaaaaaattcagaggcggtgatgagtccgaggtattaaaagggcatgtccatatcagcacagcctctggcacgctcgggaaatcgcagagagcgttcgtccctgtctacgcggagaatggaaaacaagtcggtgcagtcgcggtcggcatcaccgtaaatgaaattgatgaagtgatcagccatagcttacggccgctttactttattatttgcgtcagcatcttcgtcggtgtgatcggagccgttatcgtcgcccgtacagtgaaaaatatcatgtacggacttgaaccttatgaaattgcgactctgcttgaagaacggagcgcgatgctggaatcgacgaaggaaggaatactcgctgtcgatgaacatggcaaaattaaacttgccaacgcggaagcaaaacgcctattcgtcaaaatgggcatcaacacaaatcccattgatcaggatgtagatgacatcttgccgaaaagccgcttgaaaaaggtcattgagacaaaaaaacctcttcaagacagagacgtccgcattaacgggctggagcttgtgtttaatgaagttcctatccagctgaaaggacaaactgtcggagcgattgcaacattccgcgacaagaccgaggtaaaacatttagctgaacagctttccggtgttaaaatgtatgcaaacgcactgagagcgcagtctcatgaatttatgaacaaactgcatgtgatattagggctcgtccagctgaaagagtatgacgatcttggagattatattaaagatattgccattcagcaaaaatcagaaacaagtgaaattataaatgatgtcaaaagctccgtactggccggttttctgctcggaaagcaaagcttcatacgtgagcagggcgcaaatcttgatattgaatgcaacggtgtcatcccgaacgcggcagacccttctgtcatccatgaacttattacaatcatcggaaatctcatcaacaatggcttagacgccgttgccgatatgccgaaaaaacaaatcaccatgtccatgcgcttccataacagcatacttgatattgaaattaccgatactggagcaggcatgtctgaagaagaccaagccaaagtatttgaacaaggctattcaacaaagggcaaaaaccggggattcggcctttatttcacacagcaaagcatcgaaaatttaaaaggccaaatgatcctcacaagcgaaaagaatgaaggaacgacattcagtattcgcatcccgtacgaaccgaaggaggaaaatcatgattaatgtactaatagttgaagatgaccccatggtgggtgaattaaataaacgatacttaagccaaatagatggctttcagctgaaaggcatcgcttcttcctttcaaagcgctctgcatattttaggcgagcaccatatcgacctcattttgcttgatatttatatgccgggaaaaaacgggctggaactgctgacggaattgagagcacaaaatgaagcggttgacgtgattgtcatctcagcggccagcgagcttgacgtgatcaagaaaacacttcggtacggagctgttgattatttaatcaaaccgtttgaatttgaacgtttccaaacggctctgtctgattacagacgaaaacaaaaggtgtattcaacccatcgcaacatgagccaaaaagaactggacgccgagctttttcaaaagaaagaagcaacagaaaaagtgcagcttcctaaaggcctgacaaaaagcacgctgaagctgatctggtccagtatccagtcatttgaaaatgaatcttttacgacagaagacttggcaaagcacacagaaatctctcaagtatccatacgaaaatacttaaagtttcttgaagatatacaggttctgaatgtagaaatggcgtacggaacgatcggaagacctgtgtttcagtacaacgtcaacaacagtaaccttaacggaataaagcaatatctataagaaaacgcactgctcgctttgagcagtgcgtttttcctgtcatatctcttgccaagatgcttgattctattgttgataagttatacaagaataacaaagggcctttcacatttttaagcaaacaattctaaaaatagatactttttaaaaaattatgcgaaattctatttatttcttattagttaaatgataaattatgattggttagttgatcccgaaaaactaagtcataagtcttacttcagaaaacgatgtcacggttttccgcccggaacgccttccgcatccttctcttccccgcctttcgaaggaaatactcacaccacgcttattcagggaagaatagaactgtctcagcgcattccatttgttattatcagaaaattttatcgattctaagaaattgttcaggacagcccatcacatgactggccggatcagctttgaaccaaatttttctgggggttatatcttgaataaacgaaaaatcggattggcgatgtcacttgtgatcgcagcaggcaccattttaggagcatgcggaaacagcgaaaaaagcagcggctcaggcgaaggcaaaaacaaattcagtgtggcgatggttactgacgtaggcggagtggatgacaaatccttcaaccaatcagcctgggaaggcatccaagcctttgggaaagagaatgggctgaaaaaaggcaaaaacggttacgactatcttcaatccaaatcagatgcagactatacaacgaacttaaataaattggcgcgtgagaattttgacttaatttacggcgtcggctacttaatggaggattcaatcagcgaaattgctgatcagcgcaaaaatacaaactttgcgattatagatgctgttgtcgataaagacaacgtcgcaagtattacgtttaaagagcaggaaggctcatttctcgtcggagtggccgcagccctatcaagcaaatcaggaaaaatcggctttgtaggcggcatggaatcagagttaatcaaaaaattcgaggtcggcttccgtgccggcgtgcaagcagttatccctaaagccgttgtagaagtgaaatacgcaggggggttcgataaagccgatgtcggcaaagcaaccgccgaaagcatgtataaatcaggcgtagatgttatttatcactctgcgggcgccactggcacaggcgtctttactgaagcgaaaaacctgaagaaagaagatccaaaacgcgatgtctgggtcatcggtgtcgataaagaccaatacgcagaaggccaggtagaaggaacagatgataacgtcaccctcacttccatggtgaaaaaagtagatacagtcgttgaagatgtaacgaaaaaagcgagtgacggaaagttcccgggcggcgaaacacttacctacgggcttgatcaagacggagtcggcatttctccatctaaacaaaatctatcggatgatgtgatcaaagcggtcgataaatggaagaaaaaaatcatcgacggattggaagtcccggcaactgagaaagagctgaaaaccttcaaagctgaataagaatcgcagggataaggaggtcgagcccttatcccttgtttttcttttattttgaaataaaggagcggtcaatcaatggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacattgatgaatgtccttttcgggctgtatcagccggagcggggtgaaattcgggtgcgcggcgagaaggtgcacatcaacagcccgaacaaagcgaatgaccttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgcgttacggttatccgtaaaggaaaaggcatcaaaacccttgatgtccgtgatacaaaccaagacgaactcgccagtctaatggtcggccgtgaggtatcgttcaaaaccgaaaagagagctgctcagccgggagcggaagtgcttgcgattgacggcataactgtaaaggatacccgcggaatagagacagtcagagatttgtctctttctgtcaaagcgggagaaatagtcggcatagcaggcgtcgacggaaacgggcaatctgagctgatcgaagcggtgacaggactccgcaaaacagattcaggaacaatcaccttaaacggaaaacagatccaaaacctgacgccaagaaaaatcactgaatccgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcagcgagtacgacgtcagaacgccggatgaatatacacacgctcgggcattgtcaggcggaaaccagcaaaaagcgattatcgggcgggaagtagacagaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggaaaccactgaacaggagcttggtctcttgatggcaggaagcacgcaaaaggaagcggggaaagcaaatggttaaacgactctctcatttactcgtgccgctcatcgcaatcatacttggtcttgcggccggcgcgttgattatgcttgtgagcggctacagtgtggccagcggatattcggctttgtggaatgggatattcggagagatctattatgtcggagaaacaatccggcaaattacgccttatattttatccggattggctgtcgcgtttgcattccgaacgggactctttaatatcggcgtcgagggacagctgctcgtcggctggacagcagcggtttgggtcggtacggcgtttgacggaccggcatatattcacttgccgctcgcattggttacagcggcagctgcaggaggattatgggggtttattcccggcattttgaaagcgcgattttacgttcatgaagtcattgtcaccattatgatgaattatatcgcgctgcacatgaccaattacatcatttcaaacgtcttgacagatcatcaggacaagacggggaaaattcacgaatccgcctccctccgctctccttttcttgaacagatcaccgattactcacggctgcatttgggaatcatcgttgcccttctcgcagcagttatcatgtggtttatcatcaacaaaactacaaaaggatttgagctccgggcggtcgggtttaaccagcacgcttcccagtatgccggcatgagcgtgcggaagaatatcatgacctccatgcttatctccggcgcttttgcaggccttgccggagccatggaggggctaggaacattcgaatacgcagcagtgaaaggcgcatttaccggcgtaggctttgacggtatcgctgtcgctcttctcggggaaacacagccatcggggttatactggcagcatgcctgcttggcgggctgaaaatcggcgcattaaatatgccgattgaatcaggcgttccatcagaggtcgttgatattgtgattgctattattattctgtttgtggcttcaagctatgcgattcgtttcgtcatgggcaaattgaagaaaaagggggcgaactaagtggacattgtgcagattttatctatcattgtccctgcaacactcgtctatgcggccccgcttattttaactgctctcggcggcgtgttttccgagagatcaggtgtggtgaatatcggcctagaaggcctcatgattatcggggcgttcaccagcgtgttatttaatttattttttggtccggaattaggtgccgccgcaccttggctttcgctccttgccgccatggcagcaggcgccctgttttcactgattcacgcggcagcggcgatttcgtttcgcgccgaccagacagtcagcggtgtcgccattaacatgctggcgcttggggcaactttatttatcgtcaaactgatctacggcaaagcgcagacagacaaaatcccagagcctttttataagacgaaaatccccggtttgggcgatattcccgtcttgggaaagatcttcttttcggatgtctattatacgtctattcttgcaatagcacttgcctttatttcctggtttatcttgttcaaaacgccgttcggccttcgtatccgttctgtcggagagcatccgatggcggccgatacgatgggaatcaacgtatataaaatgcgctacatcggtgtgatgatcagcggattgttcggcggtctcggcggcggcgtatatgcctccacaattgcgcttgatttcacgcactctaccatctccgggcaaggctttatcgccctggcagcgcttgtattcggaaaatggcatccgatcggagcactgggggccgccctgtttttcggattcgcccaaagcttaagcatcattggatcgctgctccctctttttaaagacataccaaatgtgtatatgctgatggctccttatgtcttaacgattctcgctttaaccggctttatcgggcgggcagatgcgccaaaagccaatggcgtgccttatattaaaggaaaaagataaaacattctcccctgggaagatgattctcagggatttttttctaatccaaaagacccccttaatttaattgtttattagttttttaacttaaaaaaatatgaagtgttaacgctttcttgtagactgtaacaaacaatacatgggggtgtatgacatgggagcaattccaaaaacggggacaatttcacctgagcaaaaagactcacaggggaaaaacctgtttcaaaaaatctggtcttgggaaatcggtgtgattcctctgcctttatacacagtattagctgttattattattcttgcagcctattacaatgagctgccggcaaatatgcttggcgggtttgccattattatgattcttggtgtgtttctcggagacataggccaacgcataccgatattgaaggatattggaggccctgctattttatctttgtttgttccttcatttttagtcttttacaatgtactgaattcaacatctttagacgctgtaaccaacttgatgaaaacgtctaacttcctttatttctatatcgcttgccttgttgtgggaagtatcctcggtatgaacagaattgttttaatacaggggtttatcagaatgttcgttccactggttgcaggaacgatcgcggccattgcagccggcatccttgtcggatttatttttggctatagtgcctatgattcctttttctttgttgttgtcccgattattgccgggggaataggcgaaggaattttgccgctttcaatcgcctactcacaaatactgggctcatctgctgatgtatttgtgtctcagctggttccagccgcaattataggaaacgtttttgctatcatatgtgcagccttaatgaaaaagcttggcgataagcgtccagatctaaatgggaacggacgtctcgtaaaatctaaaaaagcaaatgagatttttaatcaaaaagaagccgaagcaaaaattgatttcaaattaatgggagcaggagttctgctcgcgtgtacattctttatttttggcgggttattggagaaattcatcttcatcccgggcgcgatcttaatgattatttcagctgcggctgtcaagtatgcaaatattcttccgaaaaaaatggaagaaggcgcttaccagctttataagtttatttcttcaagctttacatggccgctgatggtcggtctcggcatcctctttattccgttggatgacgtagcgtctgtgatttctattccgtttgtcatcatttgtatttcagttgttatcgcgatgattggttctggatattttgtaggcaagctgatgaacatgtatccggttgaatccgcaatcgttacttgctgccacagcggcctcggcggaacgggtgatgttgccattttatcagcatcaggaagaatgggccttatgccgtttgcccaaatttcaacccgtctcggcggtgcaggcacagttatttgcgcgacagttttgcttcgttttttcacttcataaacagaaagagttccgttttatgcggaactctttttttatttattcacaatccgaatatactctcggggaccaaacggcagatcctttgattccgtctcactcattctggctgacaggtggtgctccagtaaatacagctcccactcatcactagccgccacaccgctgcgcccgtcatattgattcaacatgaatgcccctgcaaatactgagcagaataaacctgagcacatcacgacttttcttttcacatgaccagctccttaccttcagcttgatcaggattgattttaaatatacaaataacctcttttttgttagacttattttgaggtcaaaagaactcataaaaacccattacagcagttcgaagcgtggcagcttgcagaaaagtgcgatataatttggactaggtcgtttgaccgtatatttcatacatagcgcatttttcaattgagaacgagaaaaggaggtcttatctttgcagctcttacatcttgctattttatcgccttttttatttgcttttatcattcccttcttggcaaaatacgcaaaaagagtgcatacgggctggtttgtgttgatcctgcccgtcttgctgtttatatactttctcccaatgatcaggatgacacaatctggagaaacacttcgatcggtattagagtggattccgtcactcggcattaactttaccgtttatatagacggcctcgggttattattcgctttactgatcacaggcattggctctttggtcactctttacagcattttttatttatcgaaagaaaaagaacagcttgggcccttttatgtctacttattgatgttcatgggcgccatgctcggcgtcgttctagtagacaatgtcatggttctctacatgttctgggagcttacaagcctttcatcctttttgctgatcggctattggtataagcgggaaaagtcgcgctatggcgcagccaaatcacttttgattacggtcagcggcgggctgtgcatgctcggcggatttattctcctttatttgataacggattccttcagtattcgagagatggttcaccaggttcaattaattgccggccacgaattgtttatcccggctatgattctcattttattaggggcttttacgaaatcagcgcaatttcctttttacatctggctccctgacgcgatggaagctccgacgcctgtcagcgcttatctccattcagctactatggtaaaagccggcatttatgtgattgcgagattcagtcctattttcgccttttcagctcagtggttttggatcgtgtccctcgttggcctctttacgatggtttggggttcattccatgccgtgaaacaaactgatttaaaatcgattttggcgttttcaaccgtcagccagctcggcatgatcatctccatgctcggagtcagtgctgcggcccttcattacggacatacagaatattatacagttgccgctatggctgccattttccatttgatcaaccacgcaacctttaaaggaagcttgtttatggcagtcgggattatcgatcacgaaacaggcacacgggatatccggaagctaggcggcctgatggcgattatgccgattacttttaccatttccttaatcgggacattttcaatggccggcctaccgccgtttaacggatttttgagtaaagaaatgtttttcacaagcatgcttcgcgtgacacatttcgacctgttcaacgtgcagacatggggcgttctgttccctcttttcgcctggatcggaagtgtatttacgtttatctacagcatgaaattgctgtttaaaacattcagaggaaattaccagcctgaacagcttgaaaaacaggctcacgaagcgcctgtcggcatgctcgtaccaccggtcattcttgtcgctttggctgtcagtctcttctttttcccgaatatattgtcgtacagcttgatagagcctgcgatgaactcaatctatccgacattgcttgccggccatgagaaattccacgttcacatttcacagtggcatggggttacaacggaattgctcatgactgcgggtattgttgtgatcggaacaattggttatttgtcgctgaataagtggaaaggaatctataaactgtttccttcgaaactcacactcaaccggttatacgataagcttttgactctgatggagaaaggctcttaccgggtcacaaaacaatatatgaccgggtttttaagagattatttgctgtatatcttcgctggtttcatcattctgataggcggagcttttgccattaaaggcggattttcatttaaaacggaaggcatggctaaaatcggtgtatacgaaatcattttgacgcttgtcatgatcagtgccacagtggcgactgtttttgctaggtcaagactgacggcgatcattgcactcggtgttgtcggttatacgcttgcattgttttttgtcattttcagagcgccggacttggcattgactcagctcgtcattgaaacgatttctgtggcactgtttctgctttgcttctaccatttgccgaaactgaggctgaaaacaaaaacgagaacgttccggatgacgaattttatcatttctttaggcgtcggtgttatcgttactctgctcggcatcgcatcctcaagccagcggacaaaagacagcattgcgtccttctttgtcaaacacagccacgatctcggcggaggggataatgtcgtcaatgtcattcttgttgatttcaggggatttgatacaatgtttgaaattacggtattaacgatagccgctctcggcatttacagcatgattaaaacaaaagtaaaagaggaggggaaaagcggtgaatgaacaaaaaacaaatgacttgattcttcaaaccgcgacaaagcttgtatcctttatcattttgcttttctctttctatttatttttatcagggcataacgcgcccggaggaggctttgtgggcggactgatcacgtcctcttccatcgttctcttgctcttggcgtatgatttaaaaaccgtgcgttcccttttgccggtcaatttcatttatgtcgcgggagccggccttctgctcgctgtattaacaggcgttggctcctttgtcttcggggctccttttttaacccacacattcggatactttcagctgccgatccttgggaaaacggagctcgccacagcgacgatatttgatttaggcgtttatcttgttgtcgtaggcataacgatgaccattattcaaacgattggagaggaagaataatggaaatcttaatggctgtattagccggtattatttttatggctgccacgtatttgctgctgtctaaaagcctgcttcgcgtcattatcggaacagcactgttaagccatggcgttcatttaatgcttttgactatgggaggattaaagaaaggcgccgctccgattttgagcgagcatgccaaatcatttgtcgatccgcttccgcaagccctgattttgaccgcaattgtcatttcttttggcgttacgtcattcatcctcgtcatggcctttcgcgcttatcaggaattgaaatcggacgatatggatcaaatgaggggaaatgatcaacatgaataattttgttattttgccaatcctgatcccgcttttgtcggctattcttctgattttcatgacgaagaatcttatgctcatgagaatcttcagcacggcggcatcggccatcgggattgtgattagcggcatacttgtacagactgtcttcacaaaaggcatccagacactcagcctaggcggatggaaagcgccgtacggcattgtgcttgccgcagaccaattcgccagcctgctcgttctcacaacagcggtcatcggtttattggttgggctttattccttccgttctatcggtgaaaaacgggagcgctccttttactactccggcgtacagttcttgcttgccggcgtcagcggagcgtttttaacaggcgatttatttaatatgtacgtattttttgagcttctgcttattgcttcctatatgctgattgtattaggcggcacaaaaattcagctgcgcgaatcccttaaatatattgtgtttaatatcgtgtcgtctgccctgtttgtcataggggtcggctttttatacgctgtaaccggcacgttaaacatggcggatcttagcgtgaaaatcagcgaaacaggacaaaccgggctgatcactgtgattggtgtcctgctgcttttggtatttggcatgaagggcggaattttccccctctacttttggcttccaggctcttattacgcgccaccggcagcaatctccgcgttgttcggcgctttgctgacaaaagtcgggttatatgcgattgcgagggttttcacattgatttttattcacgatacagcctttacccatcagctgatgatttggctggcggcgctgactgtgatttttggtgtcatcggttcactcgcttattcgaatgtcatgaaaattgtgatctataacattattaccgctgtcggcgtgattttgttcggtgtggcagtacacacccccgcatctattcagggcgcgatctactatctgattcacgatatgctgattaagggcgctttgtttatgctggcaggtacgctgatcgcattgactggaaccgcgagcctgcataaaatgggcgggctgatcaaacgctatcctgttcttggatggatgtttttcatttccgctatttctcttgcaggcattccgccactgagcggatttgtcggcaaatttaaaattgcggagggcggcttcgcagaaggtgaatttacgatatccatgctgattctgctttcaagtctgctcgtactgtactctgtgctgaggatctttatacatgcgttttggggcgaagaaaaagaaacgccaaaaccaaatcatcgaacagctaaaggacttctttatccggcagctatttttctcttgctgtctcttctcttcgggttgggtacagaatgggtgtcgccttacgttgatcaagcggccgagacgctgctgaatccggaaaaatatatcgaagctgttctgaaggagtagatcgcatggcatttcaaattttattaaatgtgtttctcgctttttgctggatgttcttaagcaacagtccaagcgccgcaggattcattacaggctatattctgggaatgctctctctctttttcttccggcgctttttcactcgccagttttatctatggaaattgatttctatcatcaagctctgtttcatttttataaaggaactgtaccttgccaatgtcagtgtgatgaaatcagtcttatctccaaaactgaatatcagaccgggtatttttgcttttaaaactgaactgacgaaggactgggaaatcaccctgctttctctgctcattacattaacgccgggaaccttggtgatggatatttcagatgacagaacaatactttatattcatgcaatggatatcgaggatgcggaaaaagcgatttttgatattcgggagtcatttgaaaaagccatacaggaggtgagccggtgatgtttacgctgatcctgcaaatcgcgctcggcattatggcagtgtctacctttttgtatgtcattcgtgtcattaaagggccgactgtgcctgaccgggtcgtggctctggatgcaatcggcatcaatctgatcgcaatcacggcgcttgtctccattttgctgaaaacaagtgcgtttttggatattattttgctgctggggattttatcgtttatcggaacgatcgcattttccaagttcctggagaaaggagagattatcgaaaatgatcgaaatcgctaaggttgttgtggctgtattcattttgctgggtgctcttatatgcctcattgcgtcatttggcgtacttcgccttcccgatgtgtttacacgcgctcatgctgcttctaaaggctcaacattaggtgtcaatatgattctgctcggtgtcttcttctatttgtggtttgtgacgggggagctctccgctaaaatcctgcttgggattctctttatctttattacgtcgcctatcggcgggcacttgatctgccgtgctgcgtataactccggcgtcaagcttgatgagagaagcgtacaggatgactataacggaatcagaaactttgtgattaaacgaaaagaggattcttatttataaaaataagcagccggacaggcagagttccggctgtttttttatttcttgatgacagccagcgtgcatctggatatacagatcagcctctcttgctcgtcatatatgtgaatatgaatgaagaacgattttgttttgaatactgatgagcataatcagcacatccgtcgcctgagagtgcttgaccgcattagacagaaactcttgaatgatccggtacaaattcagctgcgaatccagatcaagggaagccgtaaatcttccggtatttaaacgaatgtgaaacggaacccgctcctgctgctgcgccaccagcttcgacagcgccttgaccagcccaagatcatacagaagctgcggccgcagctcatgacacgtctccctcgtcatcgaaatcacatcagacatctgctcattcatctgtacaagcttgtcctgcacctcttcacggcacggattatcatccttcttgaaatcacccaaaaacagctcacactggcgttttaaggaaatcaaatcctgaagaaccgaatcgtggagatcacgggcgagtcctgaacgctgtttttcttcgattgcaaacattagctttttcagccatatcgggttggttccctcttgctttaagtccttcaaatgttccatgagctcctcaatatgcagaacattttccatggacacacttgtataaaaagacagtgttttcagccacgatatttcatcacgtgttagccggggagtgttaatattagataaacaaagcagaacataagaacttccacctcgttcaccaactttcataagaaagccttgattgacttctataattttcccgatttctgatgttacgttttcaaactcctctttataaagatgccattccggttcgatttcatgcttatctaaaaatatcactttgtgatcaggagttacctcaaaggtataagctttgcttacatgtaaaacatccaaaatagtttttttcagttctttaaagacttgttgaagagaagttacacctctcattagctgagtatatttaaagatactgtcctgatagttgaatttttcagagaaacgttttaaccgaaatttaaaatctatgacctctttaaaataaaagacagcgaacatgacaacgaaaaaaaataccgtttggcgtaaaggattcatctgtatttccattacatcaaacagaactaatgcaccaactataagaagagttggtatcatggcaagtagagcatagtatctcattcttcctaagataaactctatatcaaacatcttattggctacaaattggtatactaacccgaacggaattagtactagtaatgacgccgaagctaatgccgggaaaatataattacctgtaaatattattggaagaacaaaaaatatcaaaaaaggcgcaaatgataaagtgtttgttaaaattagtaatttaagaataaacgaatgctcagcatatttatatttattaagatgaaaatatatcgctgaaaaagaaaatagagtcaaaattgcaaaagaaaccaagttaacagtcgctaaaaaatcaatatctacttgtaaatagtcttgaaaaaactcaattccaagattaaatattggtatgatataaagaaaggagattctattcaaaaaagtttttcctatttctccaaggtatgtttgtataaattgaagataaagaataggagaagatataaaagtaaacaagttaatataccgattgattatatgtcctctaaatggtccacctgcacttatatatgctatcgaaatgtctaataacaatagaataagaatataggcagcaaatgatctcctttttttatttaccttaaatatataaaaaatgcatattatgcttaaaaagtaaaaaaccaaaggaagtacgaacagaaaaaaactataagatctatttagagtaactaaatcaaaatctttgagatgaatcttttttccacttcttaaaatatccaaactgttaatatgactcaaatatccccatttcaaatgtttgtctgaaggtttttcttcattgatttttaatatgatatctccctgtctcagaccaacaaattgtccatatgaagattttgatatttcttctattacaaattgacttttatcatttttttgaaccttagtcccaataataatcccattcatactaatataagttgtatagcttatatagaggatactcaaaacaattacagctattgtgaatttttttatcaagttcttcaatgcaaatccacctattaatcaccccattgacgggttattggatcagcccgataataatcattataagctttaattattgtttcagtttcttgcacatcaaaaccaataaggcaggcttctttatttttcaatttttttaaagcctcaggataatttaaaaagtagttaattaggtcttgcaccttgtatcccctttttataacttagtaagctttcctttattaactcttttttttctttatctaaatttaattgttctatagtagaaaaacatttttgtttgtatatctccaataataccgaaatgtattgagtaactcctgcctgaattaatttttcttcgaatttctccctatctaataatgctttataatataagtctttatgtgaaaataaatataataattcttccgaagcattattaaacaatcgcttaagatataagtaaatcagtgtttgtttgtttttttcaatatcactgcgattcccagataaaagaacatgataatctccagaaatttgagctacaatccctttataataggaatatctttcaactgtttcattatattctcctgtagccaataaaacacctgctacatttgctagtgcaatcaaacttccacattttaatctaattacttctaaactttcatcttctgttttagatttattagtgatatcgtcatgttgaccttgcatggcttcgtttacgtatcttaaaacatatttaaaaattaaaggattggtatttaatgaataaatactcgttaatcctactgtatacaaggaaagagctgcatttaaagactctgagcgattaattttcatccataaagcatggtgattatcttcatcttcaagatcatccataatatctgatgaaagaataagtatttctattcccgcaccaagccatgttgcaacatctaaattctctcctccaaaaacaacataatgtaagattgcagattcagcaaaggagaatgtttctttagaatcaataaatgagcaaagaagttgtgacaaatctttgttagatatgttttgcttcacaatctccttcattttctccttgatccggacagaatctaaacatatctgctcaataacgacttcccccctcccattccattttactaaatgggacatttaaaggacagcaggtttttcgttttttaacaatcatataatactttatccatttattgtatcggtagaacgaaaaaaaagacttgtttccaagtctttttcacgaaattttcattgcataattgtatttatcgagttgatcaatgcttttgttaatgtttcgtaatgaatctgtcgtttctttaatatcaagttcgagtcggaataacaattgttttacttcttcaagtttcttttccatcgtttccacactcctttttttgaaagatcaatgaattgtgtatggtgaacgagtcctaggtatttgatctgttactaatagtgtatctgctttcggctcatttttcaccgaaaagtatgcaaaaagatcctgcgtgacaccgcaaatatcaataggcccttatactcaaaggaatcacaacaagaacgggactatctttctatgcgaaagagcgtttatatgtgctgaaattgagaaagattcttaatctccttgattttaacgggtttcgcatttttactaagcaagactatagtccttcataccgtattttcaaaattgaatatgcgattcttggcgtttcctgaccgacaaacaccgaaaaagaccgcaacgctaaagttgtggccttttcgctttgtcatattcggcaattagggatctatacatatagaaacatcctttttttgtgaggtgctcccatgagatatcgttatccctggttttacgtgtatccgtatgaggtacgccgtccgcccgctcctgccaacaatattgatacctttatccgttcagcgaagcaggccgcagggatatttgcggatgcccagctcgttctcggccgcattgcgggctcgcgggagctctcgcgccgcattctgaccgcagccgagcagtccgataaacaaaccataaagcgcctgatcaaacaaatgggcgtccggcatgaagtggatacggtctttaatcccgacggcatctatatcagccttatcggaacgcaaagccgaatgattcttgctttgcggtggtcagaggaccgcaatcattttgcgtccataagattatgacaccattccagagcctcaagataacattcatacgcttcttctttgtcgagttgattgcctaattccgagcaagtgtcccagttgttgctttcaattaatttcacaagctcaagcatttggtagtagtcgttttgatggcctaataatgcttgcccgacttcatcttttaaaggcaattcttgaacaatttcctctatttctctatgcaggagggtgtctatgagagaaaacattccgatcagcatataagaagcaggctgcggccgggatgtctttctcgccagcagttcgcaaagctttgctcttatcaaagaaatcttaatgatttcgtgcttgctggaatggcctttcctgcttaaatccttaaaggaaaggatatatatccaccgtttgatttcattaaatcccagcagcataatggcctgttgaatgctttcaattttctggctcaaacggctatgggatgagtttaaaaattttaaaatttgataggacagtgataaatcccgctctatgtactctgtcacacactttatgttaggctgctctttgctcagttcgttaagcagttcatagtaagaatagaaatgagtcgataggtcatgcccgctgatgatgcgcggctcgctgaaaaagtagccttggaataattgaaagccgtcttggaccgcctgtttatattcttttcgggtctctactttttccgctaaaaaaatcaggccgcggcagccgtaggtttgcaaaatttttctgcgttccattcgtgttgttttgagaaaatcaattttcaatatatcaatataactcatgagtttttccagtaagtcctcatcttgcgggtttattgcataaaaatcatcaagcgccagcatataccccatttttttcaattctttgcatctagaaatgagggccggcgtgatcggtatatcttcaaggatttcaatgacaagctgtttcggattgaaggaggtgggaagattcgaaaacatcaggctttccgtaaaattaacaaaacagcgtttcccttccgtcagcttctcaattccgatgtttaaaaagctgttgatcaccaaatctgttgttgcctgatcgccgtctttagcgctatacacgttctcttcgctttctctatacagcagttcataagcaacaacctgttcttttctattaaaaataggctgtcttgcaacaaacaccctcattgatttatcccccttacaatacgcgcggctttcacccctaagtatatcaaataatttgacgaaaattgtctaaacatgaaaaataatatatacataaagaaaactggcccttcgcgaacgaaaggccagtttttctttattcttcctcaagctcttcttcaattctgcttttcacttcgtggatccgctgcattttattgctccagcagtcctcgcttaaatcaaccgggtattcctccggcttgctgattctcttatattcctcccaaagcaggctgaggttatcctgcacatactgctgtatgtctgaaatctcagggttttggtagcaaagaatacctttctcaaaaatcagctcatgaagatccttcgcataaaaattcgtgacaaatttgctgatgaatgtatgaaccgggtggaacattctgagccgcttctgatcattcacctgctcatcataaagcgcaatatagtcgccttcagaatgatgattggactgattaataatgcggtagactttctttctgcccggtgtcgtcactttttcaggattggacgaaattttgatcgtgtcaaccattttcccgtcttcttcaatggcaacgagtttataaactgcgccgagagccggctggtcataggcagtgatcagcttcgtaccgacaccccagacatcaatgcgcgctccctgagcctttaaattcataatggtgtgctcatccaaatcgcttgaagcaatcaccttcgcatctgtaaatcctgcttcatcaagcattttccgggctttttttgacaggtacgccaaatcgccgctgtccagacggatgccaatgaaattaatgcggtcgccgaattccttggcaaccctaatcgcgttcggcatgcctgaacgaagcgtgtcatacgtgtcaactaagaagacgcaatccttatgtgtttccgcgtattttttgaaagctgtatattcatcgcggtaagcctgcacaagcgcatgcgcatgtgtgccggaaaccgggatattaaagcgctttccggctcttacattgcttgtcgcgctaaagccgccgattaaggctgctctcgctccccacatggccgcatccatttcgtgcgcccgtcttgttccgaattcaagcgcaacttcatcaccaatgacgcctttaatccgggcagcctttgttgcgattaatgtttgatagttcacaatgttgagcaaagctgtttcaatcagctgcgcttctaccaggggtgcctccaccctcataatcggctcattgttaaaaacgagctctccttctttcatggagtaaagtgaacctgtaaaagataagccgcgcaaatattcaataaaatcttcatgatacccgagttcatcctgtaaataactcaaatcgctatccgtaaacttgaaattttccaagtattcaatggctttttccaagcccgcaaatacggcatagccattttcaaacggaagccttctgaaaaacagctcaaaaatcgctttcttttcatgaatgccgtctctccagtacgtttccgccatattgatctgataaaggtctgtatgtaatgacaggctgtcatctttaaatccgtactctaacactgtttttccccttccttactctgccacttgcgctccgatgctgtttgcaaaatgggaaagagcccatgcgtgcccctcctgattaaagctggcaacagcttgtttatgcacaacaatccgaaaacctttgttgtatgcgtcaacagctgtatgcaacacacaaatatctgtgcagacaccggcaaggtgcagttcgccaatctgccgctctctgagtttgagctctaaatcagttcccgcaaaagcagaatatctcgttttttccatgtagtaaacattaggttcatgttcatgtttctgatatagaggcaaaagctttccgtacagatcttttccttccgtgccttttatattatgcggaggaaaaagactggtttcagggtgatattgatccccttcatcatgagaatctactgctaatacgacgtaatcaccgtttgtgatgaattcttcagttaaattgacaatcgcctcttcaatcattctgccgggctccccgcaggtcaattttccgtcactcgccacaaaatcattcgtataatcaatacaaataagtgcttttttcatagccggcctccccgccatcagtatgagaacattatatcttatctccagttgtaagtgaattgccatgaacaaaaagacaaacggtccgtttgtctcttaagatttcagcactgaccgattataaatgtcgtcctgaatatatatcaattcacgattcacagcgatgtcagccgcaataacgaggcctaaaggcgtatgaaactgaagatcagatacaatcttgaagggcactccgtaccggttcgccatttggatataaggagagtaagactgatactgaagctctccattaaccaaaagggtgacgtcatggctgtttttcagctcgtgctccgcctctttatacggtttacttctaagcacctgtcctttcgtcagtgccaaaacgactctttctcttaaagagcctaaaaacaaatggcgctcgtcaggctttgtctccaaaggcccatacattccttgctgcaaatagagatccattttatcttcactcaaaagcctgtcctcccgtcttgtttgtcttcattatcacctgatcaggcaggagctaaactttcaagcgccgcttacatttctgttacccaatgaatgatttttttggccagctcaccagcaggggtttcctctgtatgccggcgcaacgacgcttccagccgttcaggcagagttgctttatcttcttcataggaaatgatcgtgctccactccagctgcggtaccgctacaagcgtgcgcagttcttttctgttatcatgcagatacacgtccgtgatcattccggtttgcgtattgatatttgcttttctgattttcataacatgacctctctatttaaagactacccatattatacaataaaaaagcaacagcctcttgtgaaaaggctgttacccgttaaacgaaactgtttcatcagtgatatcggcatctttgaagagagttttactcgtttggttgttaatcttcacaaaatcaccaagctgaaatgcgcctgaccccgcccctgaatgagcgacgctttttggcgaaatcgcaaatacgtctccaaagcttgccgcggcattacccgtaactgacatgatataaatcggccccacaattgcaggcatttccccacctccgcattgatttacagcatcatatgcaaagagccgctaatggtgcccgcctattcagctggctttgcgttttcctcgagtcgtgaccgctggcgcagcttgatcaagcggacaatattcaggaagaacgccttcactaccgcataaaccggcaccgctaaaatcatgccgagaattccgccgaagcttcccgctccgattaacagcaaaataatcgtaagcggatgggtattcagacgctttccgatcacaagaggagacagcaggtttccgtccagctgctgaacgatgacgaccacaataatcgcaaacagcgctttggccggcgagtccataaaaccgacaatgacagccggcgcggcaccgagaaaaggcccgacatagggaatgatattggtaatcgccatgacaatcccaagaatcagggcatacggcagtccggcaattaaatagccgataaaacacgctgttccgacaaaaagacagattaacagctgcccctggaaatatgccgcaagcgtatcggataaatctttaaaaatctttaagccttctgtccgataagaagccggtagaatttttactgccaaatgcggaaagcgatgtccgtctttcagcatgtaaaaaaggataaatggaacagtaataataacaagcgtgatgtttgtcacgacgccaaacaccgcagataaactggacgtgatattttgcggcaggttttggagaaaacttgtcaatgactgttcaatttttgatatcgatacataatcctggttcatcatccaggtaaaccattgagaatgggacaaatcctttgtcagcgcctgaatctgttttatataatcaggaaggttgttaaacagccctgtcacctgtgaggtgatgataggtccgactgacgctgaaataaaggcaagcaaaccgataaacagtaaatagatcaatagaatggataatgtccgcggaatttttttctcaagcaggcggaccaccggattaaatatgaaatacaaaattcccgcaatcagcatcgggaaaaacaatgtcgagataaaaacaataaacggctgaaatacaaatgaaacttttgttgctacaaaaataatcagcaaaacaaataaaatctgcaatgtccaaaaatggacttttgatttcaacaagctttgttcctcctagtttttctttgtctgtcagataaaagaacttataccccatcattgtaacaaaaatgaactcatatcagaactcttaatataatgaaaggagtgttggtgatgaaggccgtgacatacgatacagattcagaactgtcttatatctatgttcttcctccgaaaaagaacaggaatgtacggactgaggagctcagagtcaatgattgtctcctgctggatatcagccaagacggcaaaatcgccggattcgaatgttttggtgaggcagcacacctctgtgccccatttgccgggaaatcccggctatatgtaaaagattcagacggttatcattttcgggtctgccagcatgcttcagtccgttcctgctatacggtgtacggtgtcactttctgtttttcagatggtgactatcaggaatttgccggctttgaccttgacggaacaatgtatcatagtgcgtttttacagcgcttaactgaaaaataggacgtcctagtgtacgcctatttttcatgcgcaagcactgttagacccgctcactgtaatctggggtgacggaaatcatgtgctggattctgatcaaacaaacagaatttcgggctccttcaattgtgatatggtcaggttttacatcgatcagtctgcctctgaccgtatctcgtactgtctgtataacgaaccttgagccgatgagctttttaatggtctgatagacataaggatcgactaaagagaccagttgcggactaccttggttgaccatacttttatcccctttgtgtgttttatctcagcttatgccgcgcttatggataatgacacaggcttacctgattaaacaaaggggtgcggagattttaggagaatacgtttggaagcgggtgtaaaggaagtatcgatgaagcggagacagcgaagaaagctgggcgctgttccgtacttatacaggctttatcacggatgcctgggcttggtcgattaattggtccagcttttctattttttttcgtgcggttgaaggatcaatttggcggtaatgatggtggccgcccggctcttcatccagttcgtccgcttttttgacaatctgctgcagcgtgtttttatctaattcgccttcaggcaaataggaatctgtatgaagcaaaatggctagtgcaatctcttttgccgctttcggttcctcgccaagccgaatcagaagcttatgcgcgcgttccgcccctttaatggcatgaatgtcatttcttttgtatttctcataatcccactttccgtctgtataccattcataatggccgatgtcatgaagcagtgccgcttttgctgctaaatcaggattaatgtcagccttcacagacagcctgtatgcatgataagcgcaggcaatcgcatgtgccacgccggaacgctgaagatatttttgtgcaattggatgggtgaaaacatccattaatgtaacctttctcatggaaacccctcctttagatatttttagaatcctaacataatttgcagagaaactcaattcttatgtcacatcattttgatcttcttatcatcattgttataccctaaaagcagcgtttcagtcagtatatgcggctgttcaataaaatgcgctggctgcagccttttgtataaaaaaaagagcagaaaatatctgctctacaaaaactctttaatatcataaatgcggccgttttccgtccctttttctagtaaagaaagcagcgtgccggcaataaagtccggactgcgaaggcttcctgtttcatttaatttccggaatcgttcaatgtggtggaaatcctttttcgatgaagaacggatgacggcctgcatctcagtgtccatcactccaggtgagaacgaaatcatgttcaccggcagctcttcatcctcctgttcaaatccgaatgtcctcgtaaacatgtcgagcccggcttttgaactgcaatacgcgctccatcccttatatggatttttggcggctcctgaagtaatgttgacaaccgtctttttgccgctgtatgaagcaaaccgttttgtaaacagctgactcaaaagcacgggcgcagtcaggttcagctgataatggcgctgaagctcgtcaagagacgcttcgccggcacgtttgatcggcgttaccattccggcgttattgaccagggtaataccagaataacgatctggatcgatggatgagagcaatgtttcaaattgctgttcagcttctttgagattgatgaggtctatttgatgctgcgttagtttttcatgagagacatccgttttcgttctggataaggcatggacttcatgccccttttctaaagcctgtaatgcaacggcttgacccagcccttttgacgctccggtgatgatataaagttccattggaaacctccttttccgttattattgtacggcactgcttttacacaacacaagcacgcggcctacgccttcttgttttcctgcgctgtgacttttgggatgaggaacacgatgcctgcaattccgagcaggatcagtacgacatagatcatcggcagcagcaatgatgatgtttcttgttcatcttctgtttccgttgatgatgtctttgttattggtttttcagcaaatgtaattccaagctgtttcgactgggccgcaatcgtgttggaatcctcggcatttgttgatgtaaacaaatcttttatcagctcggcgtccttgtccttcggtttatcaaaagtaatatccttctgttcctcaggcagttctgttttttcttcatagtaggtatcttcatgcaaataattcgtatcgatttcgatgtcttttttctcatactggtttggcgcgacatctgtattttcttcagtttgggcagccgcggcagagggtatgaaaagggaaaaggagagcatacaaatcatgatccccttttccatgctgcgattacgcttcatacgtttcatcgctttctgctgtgtgttcagccatcagccggataatcagcggcagagccgcggcaatcaccgtaatgatcagcagaactgttattcccattgtaaacaagtgcccagtaccgtactggatgtcgatatatactttcgaaaccggatcttcaaatgtaaagttcggcatgatcaaatcaataagcggtgcgacatagaatagaatcatagctgctgaagcaacccatccagggattgatccgaatctgaatgccgtccggatgaaggcagagcttgcgaccagcaatagaatcgtgaacaccgaccacttaatcgtctgatcgtctggcagtgaataaatattcaaaccgaacaagctgatcataagtccgacaaggatattcagaattccgaataacgctcctttgacgagaagcggtgcgttttggtaatacgagctgaaatagccgattaacagactgctgatcaacacaatgacaaggatgacaaccggcggtaccgtctgaattttttcttccggaacctctccgctgattttaagcggattcgctaagtaatcatatacatagccattgttttgcccgtctactaatgtgtttccgagtatgccgtatacgtcattgcgcacgagtttcgtggaggcgacatttttccccagttgttgtttaaggtgtcggctttcgcctgaacatcattgacgctttgctgcatgttggttgtgtaatcaatgatgcctgactggcgatcagacaatgaccccatcatgtctgacatttgcagcacttcctggccgaccgtatcttggacactcagtgccatggtgccagacagcccatcgttgctgaacgtcgcagattcctgtgttgcgcccgttacaagctgttctgacgcttttgcggcactttcagagattttcgtcagttcgtcgagaacacctgcttgagagtcacgaataaagccgctgtagtcatccgcaaatttagtcattccgtcgatgaaggtgttaatgtcttcatcagtttgcatcgtgttgtttttgagagcttcccagctggctgattcttcaggtgagagagccaggactgatttgacgttgccctgctggccgtcaatagcgccggcttttgcagcactgtcaatcgtaccggataatacagaatcataaacagacaaatatttatagtatttcattgctgtatctatattttctttacttatatagattgctttggtaaatgtgagctgatctttattttcaagttcttgaatggcgttatacatatcactataaataccttcaagttctcgcttccgtttcgcttcaagattttcaagtttatcttcgagcgttttcacttggtctttcaggtcttcaatttcatcattaagaccttccatttgttcttttagttcctctaacttctttttcagctcttcattatgggcagtttctttttctttgagctcttcctcaatttgcttgattcgctcagacgctttgctgagctgttcttttgctctggcgatatcagaaatgtcaccgtttcctggttgatcttggtccccaggctccgtcgtatctccgccgctaccggtatcacctgaatctccggttccgccttcatttgccagcttgataaattgaagggctgaatcagaagatgcagtctgttcggcagatgtgcccgtttcggtttgtccgctgtcggacgcaccatcagaggcatcaccgttctgctcctgaccgtctgttcccttctgctggtcttgatcctgagtactgccgtccgtttgtccgtcattaccggtatcactgctgttattgtcgttccctgtgtcgccctgtgtatcatcgggctttgtactgcccccgtcatcaggtttttctggattatcagtggacggatcgtctggttcagtacccgggtcctccggtgttggatcctctttttcaggctccttcagattgtctgaaatatcctgaatatcagcagcgatatttttcagttcttcacgctgtttttcaagatcgattttcagttcttcaggattttcttctttcgggtctttatctttatcattgttgtcagagccatcgtctatgactgggtcgtcccctttcgcaactgtcaatgcctgacgtgccgggacaagcaattcatacacctgatttagtgcagcctgtcttgatgcggcctgatattgatcgattaaattactttggatttttgccatgccaagttcctgctgggacacttgcccttccctaatttgctgggcgtttgccagcacattactggtttgtccgagctgtgtcttcgcttggctgatcccagttgccaatccgctcatgcgttcgctgaactgattcgccttttgctgtgcctggatggcatccagacctgtccggatttgctgctgtgttgaatcctgggctgccaaaagcagctttttctgattttcttgatattccttgtatctttcaactgtttcaatgaattctttcaacgtgtttttagcttcctccgctgtagaagctttttcttttgtcgtgccttgcgcttcattcattgatttcttcagctcatcgattaagtctttttgctgtttgatttcacctgctaaatcattagagcttggtttgtaaaagttgtacatgacattctggaattcagattctttattgacgatcttgtcaaattctcctctgacgttgtccactttttgtgaaacaaaattccagtataaggccgacatttttttgttcattgtcttttgggcatcctcaagctcccgctgaactttttctttgttaaccgcattcaggttatcttgaatgctgaattcgagcgttgctttttgaggatggtctttgtcatagctcaaaatgttttttgagaagtctgagggaatgtagacgatcgcatcatatttctttgaagcgagaccggtctcggccgcgcttcggtttacgaccgtccacgaataatcaggacgttcacccagaacggccgctacttccttgccgaactgggcggatttgtcctcttcatcagactttacctcatcactcaatacgcctgtgtcttcattcaccaccgcgatttgccgggtggaattgactgcttttttcgtcggatcgtctccgataaatcggaaaaacaaaaccgggagcagcaaaatgatgatgacggcggatattaacttgatcaagctttttcgttgttctgtcatctagcactctccctttcagcagaacataaaggaatttgaactttttgctccttcccgttttccacaacatatccgaagcccggctgaatctcaggctcctgtctttggtacgggagaggaatgacattttgctcagattttttcatcagcagaatcgcgtggcggatttgcttcatctcagtcgtcaaggagtcatagccttttgagaattcgctgtgatttccgcccgggataaagctgaacccaagatgagcgtatgatttcatgaagttagcgagacgatcttgtattctcgtatcaatcgtctgctggaatctcgttatcccgtcaatcatcagcaccacttgtgagaatcgcagattttgcgcgtctccttggcggacggcttccacatacatggcctctctagttttgaaaatgtcttctgctgtttcaatccactgctcaatatcttctttcgtttccaaatatgaaacagctgattccttcgcataatgagataagccgcggtcaatcgagtcaaacaggccgatcatttcagtttcatcatcaatcagatgttcgagcattacttttaagacgtttgttttcccgcgctgagtctggcctaaaatcaggcagtgcttatgcttgcctaaatcaaaatagactgggctgactgtttcttcatgaagcccgatcggtacagataaaggcttgcgttccagcttgaagcggagagaaaattctctcgtagacaagctctcaggcagcatcggaatcggtgccggctgctccattgaagcaaatcgcccttgaagtttctgtacgtctgatttcagctcgttgaacatgccgatatcatcatcggcgtcaacaggcaggaacatttgcgcgaaataaagctcttccttttgaatgatgacgcgtcccggaatcggctcaagattgaatttcggacggccgtaaatggaatatccttccgattgatccatgagataatggacaacctttgttttcaagttatttaacaatgactggcggacagcattcacccgcgttgctgtcagcataaagtagatacccaagctttgtccgtctctggaaagctggacaaattccgattcaagctcatgcatctcatccttgacaatgtcaaagttgtcaattgtgatgaaaatgaacggaagctcttcttcgctcagcgcattgtacattttgatgtggctgatttctttttcccggaacaaacgtttacggcggtcaatttcttctttgatgcgaatcatgaacttttcaatttttcttgactggtccatcaggaagtaatccgcggtatgcgggagcttcgctaatggcagcagcgttccgtttccgaaatcaaagatatagacatgaagctcttcaggtgtgtatacgtccgcaaagctcatcaggaacgttgcggctgcaatcgattttccgtagcccgaagagccgaagatgccgatatttccatcttccatcatcttataagcaattggcgcctgtctttgcagatcaggttcatctacatacgcaaagtggaaatggtctttttcgtttgaagggaaaagagtgcgcggaatacgttccgcaagcggcggcagccaagggcttggcagcttctcgattcccatttcatcttggatgcgttcaatttcgtcaactacagcttcgatttcggtttgaacgtcttttttcgcgttatcttcggtatcaacctcagaaagcgggatcagacccgtatctgtaacgatcgcgatttcatcctcggtaccgtagacttcctctaagtaaggcgccccgctccatgcagattggaacagctcatacacttcattgtttccgacctgcaaatagccgcggcctgttacggtaatgtttgcggcatcgctgtttttcaaaatttctttactgtcggtggcatcctggaccttgagcgctactttaaagcgcgagttactccagatctggtcgtcgatgatgccgcctggcttctgtgtcgccaaaatcaaatgaacgccgaggcttcgtccgatacgcgcggcactgacaagctccctgataaaatcaggctcctcgcttttcagctcggcaaactcatcagaaattaagaacaagtgaggcatcgccacttctgctttcccttgcttgtatagctttgtatagtcattgatgtgattgacttgatactggtcaaacaggcgctgcctttttttcagctcgcttttaatggaagcaagcgcacgcatactgaagtttttgcttccttcaatatttgtgatcgtgccgaggaggtggggaatgttgcggaacggctgcgccattcctccgcctttatagtcaattagtaagaaagccgcttcatgcggatgaaaatgcactgcaagtgacaagatgtaggtctggagaaattcacttttccctgatcccgttgtccccgcaagcaagccgtgcggaccgtgtgctttttcgtgaaggttcagatacacaatgtcatctttccctttatagccgatcggcactgacagcgacttcgacgattcacttgtcagccatctttgctgaatgccgatttcttttacttccttcgcatgaaaaagctccaggaacgataccgtttcgggaatggaattcgtaatgccgacctggtggttcagcgtccgcagtgtgcgtgaaaaccgttcgttgtcctcacgctgatgatgatcgagacggaacggaattcttaccgcttttttcttttgtattaaaatgtcgccttcatgctcattgatgtagcggacaagagttgtaatgttttccgacaagctttcctttgtttccgcagcgacaattgtcgagatgcccagatgctcatgctgtccttctaaatattcgagaatgacatgctcggagatcagctgctgattcgtgatgacaaatacaaaatgcggtttgaactgcagtttttctttgtcatcttcgagatcacgctctctgatcaattcgtaaagtgaagacaggagctgatctcgcgtttgctcattataaataaatccctttgcataaatatggggcatttgaaattgcggaagccacttcatccactcccagtctttatactcatcttcatgaaaaataaatacaaaacgcaaatcgtgatagctgttaaagaacgacagctgtccgatcagctggtgaatctcatttttcacaatttgtgatttaccgacaagccccatcggaccttctgccaaatcgaccgtcaccggcgcattgcggatatctttatagacgcgctgcatgtgctgcgatttctccatgagatcatcgatatcacgattcgccaagtctccgccgctcatattgatttcatagcttgacggaactgttcccgtcccaagccgcagctggagataatccttgctttcaagggatttttcccagatccggtcactgatttcacttgttaagtatttcatttgttcaaatgaaggaaagtgaaattcaagaacctgcttttgtttttcagcaagtgcctgaagctctttccgcttattgtctaagtaaagcttatatacacgctcccgtttttcctcgcgttttttccgctggtttttatcccggaaatattgcactgtcgaggtaatgagagtcatcataaacatcgccaaagaaacgagtataaatatgccgcgcggctggatgatggcaactacgcccatcacgatcagcatcacaagcggaggcaggatgacgagccacagccctctgttggtttgatcgctctcctgagagggaaaactgaaagaaacgcggtcatccggcagatcgtataccatccgcggcgttcttctgtactgcggatattttttctgcatctctgtactcggtttgaccgtttctgttaacgctgtttcaaactgggcataatgaacaatttctaaaaggtcttgttccgtcaccctcatttgcgtgaagttccagaatatttcatcccccggcttaagcggcgtattggcgttgattttctctccgttcaagaagatagacccgttttcagggcggaccgaccagctgccgcctgaacgaagcaaagaaaacgtgctttgttctgcaaatgcaaagtcttgcggattcagataaatatctgcattcgttttttctgaggaacatacaatttcatcccgatttcccgtaaaataaacggatttctcaggttcactgcccgtcaatatcaagcgtatatcctgctgatccgtttggagagtaaatgatatatccgtctcaatcgtgccgagacaatcatttcccaggaaaacttcgtatttgccgccggattcctttcttttaagagaaatcactccgctattaaatggaatggagctgatcgtaacagaatccttcacatcaggccctatggtcaccggatgagacgacgggaggttagacagatttaatttttgaacgttattttggtaaaaaacccataatagactcaaatggcgaacccccttacggccgaatggcagcatgcgatgacctgtgcttcatgtctcacgttatttgtcatcttttttctcatctttcttttctgtttcttttttctcgtcttcttttttcttctgttcttcttttttcgctttttcctcggctgcggctttttcttctgccgctttctcttctgcttgtttttcttcgtctgtttgtgtctgttcttcgcttgtatcgactaacgatgtttcagaattagactgtttattttcttgacgttctttttgggctttttcaagctcactatttactgagtcaagttctttttgtatgtcttcatcatttgtatcctcagataaaagctgctgtttatatttagctagggcaaagtaaatataatcattgtattcaagcttacggccgatactgatcgcttctttgtattctcctcgaccataatcaatccaatacaagaaatgctgagggtctgattgaagggtgactaagttattttctatatttttggtttttgcactccccaggttttcgacctcaacataggacgtcgccagctgatactgcaccgattcaggcaggctttccgcatcgtacttggacagtgtgctgatgacttcactgtactgcttgtttaagaacgcacggttgctgtccactatcgcctggtgctttggctgcgcgaaaaataaggcgtacatcgaataaataagtgccggtacaagcaaaacaatgagccccaggccgatatatcgctggatgttccacttctttctcgggatatgtatgtatgtttttgctttggcttcgagctcatcaatatgggtttgaatcagctcgagcaaatcatcataggattcagcatctaatatcgcctttgcctctgcggagaacgtcagcgtttcattgaatttcaggtagtcttcaaacgcaaaagcgccgtcaactgccaaagccgctgccgctttcagctcctgccatactctttcctcatcacgctcataaggaggaatgctttcttttactccataatggagaaaataaggcgtaagccctttatcgaatacaatgttttcaggagcgacaatcaaattcagcctcgacagattgtgctgctgtacggcttgaacaagctgataggcaaactgccatttactttttttatccttagctttcatgaagcggaatgctttataggaggagggaggttggattgtgatgattacttcatcatccgtcacatcgatttctttatgaaaaaatggatttatatctttgatcacgttagcttcaagaccgtcgagaagctttattttttcccgttgaaaggtaaatgtatagccggcatctgttttctcggcaacagcttctaattggttttctaaatatgatttttgtttacctgacattcaaccagatcctttcataatatttcaagccggtctccgtttgtaatgccgcaatcagacagcttgcattctccggaaaacaccttatccttgttcaccactctgatccagtgcccttcgcgcgggggcatagatacgctttgggcctgccaagcaatatcaattacttttttcaccgggtggtaatctgacaatctgagatcaaagacactgccgttataatgtttcaaatctattgtaatatcaatatacatttaggatcacccttacatagaaagagcgccgtcttcttttgaatcaggcgctccttccctttcatactgttatccgcggatttgatttgcgatgtcttggtcagtagactcaagtgtatttgctgtttgatcaagctgctgattcacatcttgaagcaaatctgacattttgataaatgaaggtttgagctgctcgtattgatctgcgaacgcttcgcttgaagcaccttcccacatgcttttcaaatcagagatcattcggtttaaacgatcaacctgatttaatacttcttggctttcaacgccgtattgcttcgccatcgctcttagctcttcgggtgtgacacgaattaatcctgccatattcctcattacctcctgtgccatcagcctaaatatgggctaattcacttatttttagaacgtcattattataaaaacagtttttcggcatagtcaaacaaatatgttttaattttacaaaatgagtccaatggtttaccccgaatcacttaaaaatgacatataatgtaaagtaaataggtttattttcttaatcttctcttcattctccgaataatccaaaagacccaaataactccccaactcccaaaaaaaacctttcagaaaatttgatgctacagcaccatttctgaaaggttcagttttttctttccttaattagtctcgcctccgatgactttcttagaagattaataggataagctgtcgtattatatgaggcatacaactgtcctgcaaaaaggcgattacaccgccaaatgtatatagaacgtttctctcatgaaattgtttttttgcttctgttctttgttgttgattttcacaaacaacaacaatcataataaaaggaaggggatgagatgtcaaagagaaatcaagcacgaaaagtagggagatttatgaccatgccgaatgatccgtttaaatatagttttgacagacttgaagatgtggctgatcatatcagcgacgttctgcggtgcccgatcaccatagaggatgttaaccacaagctgcttgcctacagtacacacagcgactgcacagaccctgcccggacgtctaccattattggcagaagggtaccggagaaggtgattaacaagttgtggaaagatgggacaattccagctctcttaaaaacggaccagccgatcagagtcaagcaaattgatgaagtcgggctgagcaatcgcgtcgctatttcgatttggaaaaacaagcaagtacttggcttcatatgggcgcttgagatccaaaaaacattgtccgatgaagatctgctgacattgcaaatggcagcaaaagcagtgaaaaacaggcttctcaaacttcaaatcagaaaaacgaaaaatgaagaacgcagccaagagtttttctggaaaatgctgaccggacacatccatcaggaggatgatatggcggatgggttccataagcttggaatggccgctccttcagagttttccgttatgatcatccgcataaatggcgagctgactgaaaaaatcgaacagcagctgcaatatttacaggaaacgacccagcaggtttacgtgctgctggcgaccgtagattccaatgaacttattatattaacctcacccaaaacagatcatccttttcaagatttaaaacagtttgctttaagtacgcaaaaacagctgaaggagcggtataaaatagaagacgtttctatcgcttttggcggaatatacaactctatttcttttgtctcccgctcctatcaggaagcattgtccgtcttaaaaacgaaggaacggttcactgaagagaccaaacattttttcagcttttctgagttaggtatttatcaatacttagatgtcttaaatgaaaaacggaaacaggcgggccattataattactcgctttccaaactggaacaatatgaccggaatcaccagtcaaatctggtagagacgctagagcgctttattgaagcagacagcaacgtgaataccgcttctaagctgttaaatatacacgttaatacgttgaattaccgccttaagcggatcagccagatcgctgaaattgatttgaaaaatgtgaatcaaaaattcaccatctatttagatatcaaacttcggcacatggatttgtgaaatttcacaaattcatgtttttttattttcttaatcaaacaaagaattttccaaaatatcaagctacactaaaaatatcacagatacaggaggagacagatatgatcataggggttcctaaagagataaaaaacaatgaaaaccgtgtcgcattaacacccgggggcgtttctcagctcatttcaaacggtcaccgggtgctggttgaaacaggcgcgggccttggaagcggatttgaaaatgaagcctatgagtcagcaggagcggaaatcattgctgatccgaaacaggtctgggacgccgaaatggtcatgaaggtaaaagaaccgctgccggaagaatatgtttatttccgcaaaggacttgtgctgtttacgtaccttcatttagcagctgagcctgagcttgcacaggccttgaaggataaaggagtaactgccatcgcatatgaaacggtcagtgaaggccggacattgcctcttctcacgccaatgtcagaggttgcgggcagaatggcagcgcaaatcggcgctcaattcttagaaaagcctaaaggcggaaaaggcattctgcttgccggggtgccgggcgtttctcgcggaaaagtaacgattatcggaggaggcgttgtcgggacaaacgcggcgaaaatggctgtcggcctcggtgcagatgtgacgatcattgacttaaacgcagaccgcttgcgccagcttgatgacatcttcggccatcagattaaaacgttaatttctaatccggtcaatattgctgatgctgtggcggaagcggatctcctcatttgcgcggtattaattccgggtgctaaagctccgactcttgtcactgaggaaatggtaaaacaaatgaaacctggttcggtcattgttgatgtagcgatcgaccaaggcggcatcgtcgaaactgtcgaccatatcacaacacatgatcagccaacatatgaaaaacacggggttgtgcattatgctgtagcgaacatgccgggcgcagtccctcgtacgtcaacaatcgccctgactaacgttactgttccatacgcgctgcaaatcgcgaacaaaggggcagtaaaagcgctcgcagacaatgcggcactgagagcgggtttaaacaccgcaaacggacacgtgacctatgaagctgtagcaagagatctaggctatgagtatgttcctgccgagaaagctttacaggatgaatcatctgtggcgggtgcttaattcacaatgagcttgcagaaagatttctgcaggcttttttattttttaaaaggaaaaaagagaccatttcacgaattatgactatgaagttgatcataaaggaggattcatatggctgttcagcaatatggcgtgttaaaaggcatagtcttagacatgaagcgggaaacagatgatgacagtcctcatttccaagtcaaaatgctcggtgaagagaatacgtattacaggtgcgccatcaatgtgatgtccagttctgaggaatctgaagtattgtatttggctgacgatcagtttgattcaggctcaattaccatccttccgaacatgccgtatggatatacaaggatcaatgaagcaaaccgtgaagtggcactggattatgtgcggggcaatttgtttgacccgcgggaaatgaagcctttgcctcatgaaatcacaggacctgataatgatttaaatgattttattgaaacctatatgaagaaagcacaagatgagaaagcgccggtttatatattcggttcaaaattcggacctgaacaggctgcagataaaatattcggctttaccccgaccaacggaatgcacaatatccatatgaatcaagggaatgcaatggatacccgctggaaaaaagacaacggctcttggcatgacgggggtattctgattcagtttgcagatcagtgggccgctgtgtttttagcgtttttatcccaatcttggtgtaccgatgaaaacggaaacccggtcagggattgtgatcatacccaaacgtctgcgtaagatagaaaaagagactgcggctagcagtctcttcggaagtttgttgacaaaatcctaaagcgttttaaaagctttaggattttgtcatgttttcagcgtgattgaaaacccttgaactctaggaaagatgagcattggagcggagcgaatgttctaattcgtgagcaccaacgcgcagacttgacaacgaatgcgagggtttatcgacacgctgaagagactacggcgagcagtctctttttgatacgattacacattttcaacagtctttaggctgtttggcctcatatcgctccaatgcgattggatatagtccaaacaagcttcacgccctttttgctcatgaacgactgtccagccgttcggcacatctataaaaccgggccatagggaatattggccttcttcattgatcagcaccaaatacgtgccatccgcattttcaaaaggatttgccattctatttctcctcccttatttattcaactcttccaatttgacagcgagaaccttgccgatttgagccagaggttccggctgacataaatctttatgacggcagtcgatgtcgatttgttcaatctgtccgttaatataaggcttccacgagtcaggttcaatcgggtcaaaccattcaggaatgattgttgatctgaaaaacaaaacatttccacggaaggttttcggcttataggaacctaaaatgccgacagaattgacatacgtattcttcaaatttaaaatgaccgtttcatccaggctcgcaagcgcactgccgtcacggcgaagaatctcaatcgccgcttcaaaatctagcggtttttcccctaagctgtctggatcgtacccgcctaatgccagaagggcaataagcgcttcctcatcatccggtgcctcttttataggaaggaagtggttcggataggcgtccagcatcaccaacagggatacttcttctccttgattttgcagctgggtagccatcgcttgaacgacattcccgcccagggaccagcccagcagatggtatgggccttttggctggaccgttcggatttgtttaatgtaatcggcagccatgtcatcaagtgttttcggaagctcctcgcgctgcccgattccccgtgcctgcaagccgtagatcggataatctgttcctatattggtcatcaaaccggcataacaccagctgagcccccctgccggatgaacacagaataaaggaggcttgtctccacttgttcggagcggcagcagaacgtcaagagcgctttggcttgatcccatttcaagtctttcagcgagcccggctacagtaggtgcttcgaacaagttgccgatgctgagttcaacgccgagcgcttcacgaatgcggctcatgagctgtacagcaagcaaggaatgtcctcctaaatcaaagaaacggtcatcaatgccgacacgcggcaagtgaagcacctccataaagaggtcacagagaatttcttcctgcggcgttctcggtcctcgtcctgtcactgccgctgcgaaatccggagcgggcagcgctttacgatcaagctttccattcggtgtcagcggcaattctttcatcgtcacaaaggcagcaggcaccatgtaatccggcagtctctccgcagcatatctgcgcagttccgccgtatcaaatgtttcttccgaagggatgacataagctgccaaccgtttatctcccggctgatcctcacgaacgatcactgccgcatcttcaagctgcggatgctgaacaagcgcggcttcaatttctcccaattcaatccggaatccccgaattttcacttgatggtctgcacggcctacatagtcgagagaaccgtcagcgcggagacgggccacatccccagtgcggtacatccgagtgcctggaggaccgaacggatcagctatgaagcgttcagatgttaaaccaggccgacctagataacctcgtgctaaccccgctcctgatacatacagctctccggcaacacccggcgggaccggctgcaggcgttcatccagcacgtatacaccaagatcgggaatgccgcagccgatcaagctgtttgcccgtaaagctgccatgcttcggtctaattcgatatagctcacatgcaccgtcgtttctgtaatcccatacatattgataagctgcggtctattttcagggtggcggttataccaatcctctaaacggctgagttcaagcgcttctccgccaaaaatgacatagcgcagactaagtgcctgtccgagatccggctgttcccgttccgcctgcataaactgatagaaagcagacggtgtctggttcagaacagtcacaccctctttgacaagcaggcgcagaaacgcttctggcgatctgctgacgtggtgaggcacgatcacaagacgtccgccatgcagcagaggaccccagatctcccacaccgaaaaatcaaacgcataggaatggaacatggtccagatatcgtctgagctgaaacggaaccagtgctcggtcgctgcaaataaacgtgttacattttggtgaggaatcatcacaccttttggaacacctgttgagccggatgtataaatgacatacgccgtattcaaaggcgaaagcggctgagtcctatccttattttttggattctctacagggtacgtgtttagtttctctgccagctcgggatcatccagcacgattttcggcacgttttcaactggcggaatgtgatttgcagctttagtgttcgtcatgataaacgcaggctgggcatcttttagcataaaagcaattcgatcagccggataatccggatcaagagggagataagctgccccggcttttagcaccgccaataggccgacagccatttccaacgatcggggcagtgccaatgccacaaattgctccggcccgacaccttcactaattaggaatcgggcaagccgatttgctctttcattcagctctgcatagctcagtgcctgatcttcatatacaacggcaatagcatcaggacgtaaagcagcctgcttctcaaactgctctggcaaacttgcgtgcggaatcttttcagatacactttgccaatctggcaccatgctgctgcgttcctctggcgcaagaatatccagatttccgatttgctcgtcaggatcagactcggcagcctccaacagccgcatcaaacggtcagcaagagcctgagcagtttcccgcttgaaaagatcagtactgtattcaagcagtccttccattccgtttggtgtcccgtcagcaaggcgatcttcactgatttccagcgtcaaatcaaacttggcagaaccgacactgttgattcgcaggctgctctccatatcaggaagatgcagttcagcgtccggtgtgttttggaacgcaagcatgatttggaataaaggatgcgtcgcacgcgaacgagccggattgagcacctctacaagtctctcaaacggcagatcctgattgtcataggcggccagattcacttcccgtactctgtctagaagctcacgaaagcttgggtcaccggacgtatcagttctgagcaccaatgtattaatgaacagccctacaagatcgcccagcgcatcatcattccgtcccgcgatcggactgccgatcggaatgtcggtgcccgccccgagccttgtcaataaagcggcgagaccggattgaagcaccataaacatgctcaccctatttgcgcgagccagctcctgcaatcgcttatgaagttcgggctcaatacgaaaatgaatcgtatctccatcatgactcggctcagccggacgtgaataatcggttggcagttcaagctgatcaggcaggtttttcaaggtttctttccaaaaagcaagctgtccggcaatcaagctatttggatcatcctcgtttccaagcagttcttgctgccaaagcgcatagtctgcatactgcacagcaagaggcgcccattcgggagctcgtccgtggcagcgagccgcataagccgtcccaaggtctcgggtcagcggtgttaaggaccagccgtccccgacaatatgatgtacgagaagaagcagcacgtactcgtcaggacctatcacaaaaagctcggcacgaaaagcaggttcagctgcaagatcaaagctgtagcgtacagcttcggcaagccgatcagaaagctccttctcagcaatttcagtaacatgtaactcaggatgggcttgaccggcatctaaaatatgctgataggatgtcccctgtgattcagggaagatcgtccgaaggctttcatgacggcagacgaggtcataaagtgccgctttcagcaatccttgatccagctcacccgacaaacggacagcaaccggaatattataagtaggactcggtccttccagacaatgcaggaaccatagccggcgctgggcaaatgagagcgggatcttttcaggccgctcagctctctgcaaagcgggacgtgcactctgcgccaaatcaagatgggcagcgagtccggctactgtcggttcgtcaaagagcttggcgataccaagttcggctcccattacctcgcgaacgcggcccatcagacgggctgcaagaagagaatggcccccaagctcgaagaaactgtcatcgataccgacgcgtgccaaaccgagaacctctgcaaacaagtcacacaatatctcttcctgaggagtccgcggggcccgatcactgacagatgtgctgaagtctggtgccggcagtgctttccggtcaagcttgccattaggtgttaacggcagctcgtccatctccacaaacgccgccggtaccatataatcaggaagactagcctccatataacgacgaagctctgcagtatcaatagcagcatcagcgactacataagccgccaatcgtttgtctcccggctgatcttcccgtacaacaaccgcggcctgttcaatgtgcggatgattggcaagcacggcatcaatttctccaagttcaattcggaatccgcgaattttgatttgatgatccgcccgcccgatataatccaaagacccatcggcgcgccagcggacctggtctccggtccgatacatccgagttcccggcggtccgtatggatctgcaacgaagcgctccgccgttaaagcagggcgatggaaataacctctggccaagccggtgcctgcaatataaagctctccgacaacgcccggcggcaccggctgcaatccattatcaagcacatacacctgcgtgttccaaatcggtttcccaatcggaggaacgcccttcagcccttcttcaagaaaagctgttgcagaccaaatcgttgtttcagtgggaccgtataagttcgtgactgaacaatgaaggtcttgaagcgcctgcaaaagaccgctcggcagcgcctcgcctcctacaagcactctaagcccccgaagtttctcaggttcactcgttaccaaagcgtgccacagtgtcggtgtcgcctgcataatgttaatatcgaaattttcaatcatttgagctaatgcctgcggctcacggatcgtttctttctttgcgatcacgatttgcgctccgctaatcagcggaagatataactctaatgctgaaatatcaaaagcgacagtcgtcacagccaacagcctgtcttcttctcctagagaaaacgcctcctgcatggacaacagaaaattgcttaagcttttctgtgtcacaacgactcccttcggtcttcctgttgatcctgaggtatagatgatatacgcaggatggtcaagagaaaccgatacatccggattttccggcgaatagcgttttataatctcctgtgtaacagcctgatcaagcacaagctccggtacagccaggtcatcaggcagactggctgctatttcctcagtcgttatgatgcatgaaggtttcgcatcctccagcatgtaagaaatgcggtcggctggaaactccggatcaagggggagatacgccgcaccagtcttgagcacaccaagcattgaggccaccatctcaggggaacgcggcagcgccaaagcgacaaattgctccggaccaatccctttttcgatcaacagacgcgcgaggcggtttgcctcttcattgagctttcgatagttgacttgaatgtcatcacacatgagagcgatacgttctggcgtaagaactgcctgcttttcgaacatgtcctgaaggctgaccagcttctcggattttgccgtctcattccatttagaaatgactttttctttctcctctggcaacagaagctccatttgcccaatcagcatgtcctctccggcagaagccgtttgcagcagctgcaaaatacgccgctgatgaagcttaatatcagactcactgtatacctcaggattcgcatcaacatcaattcgcagcccgctgccgtctgttctgtcatatacattgattgatagatcatcaacaggaccggctgaaagattatgcgttgtgccccgggcgccggcaaagtcgagaccgtaatcaaacggcataagattgatttgagggccaaataatctatgattttctcctatcaatttcagatcgcgccgaagctcttcatggcgatacttatgatgtcgccgaatgctgcggatttcccgggaaatttgctgaatcagttcagaaaagctcatcgaagagcttaccgtcagccggagcgggagaaggttcatcaccatagccggtacattcagtgacgcggaccctatccgacccatcatgggcaggccgagcacaacatcctcagagccggtcatacggtgcatataaacagctgacaccgcaatcatgacttcatgccagcttcctgagaaatagcgcgccgcttcttttaacgcgtttacatcagacggaggcagatatgccatatgacgaagaaaactgttagatgttcttggcgcccgatcagccaagctcacaacttcaggtgcatctgcaaaacggtccagccagaattgacgatccttctcatactgctctgatccgcgataatctttatcctcctccaaaatggcctggagagacccaaaggaacggcttttagctgtttgtccttttataagcgcagtatatgtacttgccacacgctgggctatcagggaaaaaccgaagccgtcgatcgctatatggtgaatgcgctgataccaaaagaaacgatcaggcccggcaataaacagagcttcattgaacaaagggtcataccctaaatcaaccggctttgctaaatcagctttcatccagtttaatgctgttttttccggatcaggctcagagctgacgtcaatgacgtgcagctgtacatccggagacgggtttatcatctgccaaggcccgtccatattttcaccgaagcggacatgcagcgattccgcttccttgatcacgtgccgcaaagcttcttcaaaaagagcaatattgactggtccattgatttctatatattccgctgtattgtagattggattgtccggatcaagctgctgagcaaaccatatgccagtttgcgccccggtcaaagaatattgaagatcttttgtatcaggcatccgtttgtttaccctccttttataaataatccacgtttggcagcacttgctggctgcgggttgtgagcaatttctgccattcttcgatcgttgggcgttcagccaattccacgaaagtcacctctgccccttcacggcgccattgttccaccaatgtcatgatccttaccgaatcaagaccacgatcgagcaaatcctcttgatctgtgatgtcttccgatgtttcttgcagaagctcagcaatttgtttacggatattctcacatgtaaacacgttctttttgccagtgtttgctgacgttttttgaacgtctgccggcgcattctgcagctgatcaagaagactgtcagtcatcacggtaaacgcacagcgtccagccgcatagtccagcgccatttgatgtttttctaatgaaaaatcagcaactgcatctcccacaaaaaaggctttaatatcttccataaatgcttcgcatgctgtaacaagacagccgatatgggcgtaaattcctgtaatgatcagctgatcgcgtccctctttgcgcatcatttcaagcagattcgttctcttaaacgcgctgtatctccattttgtcagcacaagatcatcatcctccggtgccagctcggttataattttctcctcataaggaccgctgtttaatcccgggccccaaaagtctgtcagcagcgcacggtcatccggattttggcttcccggctgtgcggtatagacaacaggaatcccaagctgaacacattgattcttcagctttcgtatattcgctgaaagctctattaccggagatgcttccgctgtgaaagcatcgacaaaatagttttgcatatcgtgtattaataggaccgcccgatttggatcaggcacccatgagactttgttttgcggcatatcagatgctgtcggcatttgatacggctgaatggcaggtatagccatatgaacacttcctctcaaattgttgatttatttttttgaccctgcaagaagtttctcggaaatagcttcacgaagagcctttttgcttacctttcctacccctgtctgcggaaaggattcgacaaattcaactcgatcagggattttatatgccgccagtccgcgctctctcaaaaatgctttaagctctgcggcttttggggcttcatcccggggaataatgaacacacaagatctttcgccaagaaattgatcaggcatggagaccattgctgcatcatggacagccggatgcgccagcagatgattttctacctcttcagccgcaaccttttctcctccacggttaatttgatccttcgcccggccttcaacgacaatatagccgtctcgtgtcagcctgacgatatcacccgtacggtaaaaaccgtcctcagtaaatgaagcggcgttatgctcttctgccttatagtaaccgcgaattgtatacggtccccgcgtcagcagatggcctgtttcaccaggttttacgtcgcgatcctgatcatcccaaacacgcacttcatcatatggggacatcggttttccttgggtgttgacaatgatctcctcaggatcatccaatctcgtataattgacgagaccctctgccattccgaacacctgctgcagcgtgcagccgaaaacagcttttaccctgcgcgcggcttcagcactaaacttggcaccgccgacctgcagcacttggaggctggataaatcatcacggcgtgaggatgccgcatccatccataccatcgcaagaggcggaacaagagcagttatcgtgaccttttcccgttcaatcaaaggaaatgcgtcatctggacttggagaaggagataataccactcttcctccagcgtataatacgccgagaaccccgggtgagctcagcggataattgtgtgccatcggcagcgcggccaagtacaccgtgctgtggtcgagccagcagacctccacactccgcttcaggctgtatatgtagtcatcgtgggtcctcggaatcagtttcgatagcccggtgctcccgccagaaagctggaggaacgccacatccgatgatttgacttcaggcagttttacaggttctgcatgcaaatcctccagcggtaaaaattcctctgcctcacctgcgacaatgatgtttttcaaagtcggcagcttgctttgaacctgtctggcaagcgaacggtagtcaaaaccggaataagcgtcgggaatgatatatgcagccgcttcagcaaactcgcaaaaatatgtaatttcactgcttcgatgagaaggcagtgcgaagactggaagcgcccccagacggaaaagcgcgaaaatgacttcaaaaaactctttgatatttggcaactgcaccacaacacgatccatctgttgaatgccgagcttttgaaatccggcagccaggcgatcagcccttgtgtcaagctctcgatagctccaatgggtgtttccgcatgtaatggcaatgcgatcaccatatttggctgcccggtcccttaacaaatctccaaacgtctcaccggcccagcagccgttctttcgataggtctcagctaactcatcaggccaaggcgtaaatcctttcagcatgttgtatccctccagcaattcattctgttcatatgtgatccacgcccattgcccgcagcattgtccgaaactttgcggacgtctcctgaagctcgtcctcaggctttgaaccggccacaacaccagctccagcatacaggcggagtgagcgttcttctgcttctgcacaacggatggtcacgatccattctccgtcaccggcatcgtcacaccatccgaccatgccggtaaagaaaccgcggtcaaatggttcaatgctgagaatcgcttctcttgcaagatcagtcggtgttccgcagacggctggcgtcgggtggagcgccgccgccaattcaagtgcggttacagacggatcggaaagctctcccttaatcacgctggacaggtgccacatcgtttccgttttgatcagtgaaggcttctccggaacctccagcgtccggcagaaaggtctcagcgctgccgcaaccgcgtcagcgacaaccgcgtgctcatgaagatcctttgcggaagaaagcaattcagctgcccggcgctggtcttcaacaggatcattactgcgcggccttgagccggctaatgggttggaaacgacctgtgttcccatccttgaaacgagaagctccggacttgctccgagcaatgttcggcggggagacgtttcctcctgactggacacgtctgcggcaaacgtgtagccatgcgtgttatgctgagccagatggcgaagcaattcatccgtctgaatcggttcaggcgatgtcaaatgcagcgacctggacagaacgattttgctgagtgttccatcggcaatgcgtgccagcccttgttcaacaccatttttataatcctcaggttcaggaacaggctttatgtggtatgtatgcccagcctgctgttcctcttcctcatgatcaaattgaagcggtcctgaccagcgcacttcttcaggtacaacgagccgcgctgcttttacttgatcaaaaggaacggccccgacaacaagcggccggctttgccctgattgttttgcctgacgcagcgtctctgcaattcggccagaaagggtttccatttggttttgcccgtctgcctccggtacgatttcacatatgcctttcgctaacagtacacgatgaggagacgctaagaaaaaggcgcccggctgatattcatgaagcaaatgctccgcttttgtttctgttataacgttttgatccaacattctcatgaacctcctttaaattcagttacacgcctaaggtcgcgccgccatctacgcataaattatgcatcgtaatatgccctgcctggccagaaaccaaaaagagcacagcatccgcaatatccgaaggcttggctagttttttgagcgggatccctgttttaaatgtctcaagtgatccttttatgacttgctccgctccattctcgtcggcccataatgaccactgcatgtctgtttccgttgatccgggagatacaatgttgcagcgaatattgtattctgcaagctcaaggccaaggcatttcgtaaacatcacagccgcagcctttgaagacgcatatgccgccatagatgttcttggtacaccggcagcattcgatccgactgttacaatcgaacccgatcttcggtccatcatatatttgctgactgaacgcgaggcgttaaatacgccagtcgaattcactgcgaacgtcgcctcccattcctcatcgctaagcgaatggatcagtcccgggcgaaggacacccgctacattcactaaaatatcaatcggccccatttcacgttcgatgcgcgccgtgatctcatcaatcgccgcgctgtctctcacatccgcaggaaaagcttctgcatggcggccttctgctttgaggctgctcacaaccttttccagcttttcaggattataatcaactgccgcaatatgtgcgccttgactggcaagcgtccgcgcaacagcttcgcctattccttgggcagcccctgttataaaagcaatttttccctctatactctttgcattcatatcatcaattcctttcttcgctctaaatgccgaacagacatccagcgaaaaagactgctgcgccttgaaaaacgcaatctattgataatgattatcattatcaattataaaaataatcatatccaaatgtcatgtgacagtcaaatataatttcagtgacaaatatttttttaaaggcaaggctgagtatgtctcagcccattgaaagatgcggtccgtcagggtgaagcgcaaaacgcagcgcccggctgaccaaaacaggaagaactgaaatatgtccttctcctgaaaactcgcaaaattctgcccgtatgccttgttcagataaaacggccagccgctcataaagctccctcgcattgtcgttcatccggcttttatgatgctgctccaattctcctgcggcaagcaggatattgataggctgattgtttttcttggtgagagagacgaaatggtccgttttctcgagaataaacggtttattccaatgaatggacggacttcccgcgatatacgtttgaaacgcatcgggctttgttagcagcacctgcagcacgaaaagccctccgagcgaatggccaaagattgtttgtctttttttatcaatctggtaatctcgttctatctccggttttaaatcctcttcaataaatctgaaaaagccctccgctccgccatgctccggccattctctgccgtcgggcctttccggcagcttcgattgggctgttggcattgtaaaatcccggtggcgtgctgaggagaacggctccgctgtctcatagccaatgccgacgatcactgcagggatcaccccggttttttcgggtcggcgtccctgtattcgaacggcttccgtcatcgttccgaagacagaattggcatccagcagataaatcacaggataaccagcgggtggcggcggcgtactaggtttcgagataaaaatgtgataggtacggttttcattgcgtgaagacatcatacgcacttccgtaccaggaatcgtaaatgcgttcgatgtcccgccatttgtccggtctgttgtttgctctttcatgcagtacgacattcctctccttaaactaaaccgcaatgtatgataatgattttcactatcaactagacacctcaaataataggttttcttccaaagaaagtcaactttttcccgaataaaaaaggcaccttgatcaaataaggtacctgcagactatcaatatggaagtaaaaacctaataaagatgcgtattgtcctatttgaaatagaaccttaatcccatgtaaacctttgattttgccaagggtcgcctctcatgtgatagccattccgctcccaaaagccagggtgattttctttcgtaaattggattccgcgcagccacttggcgcttttccaaaaatacagatgcggaaatacaccccgcagcggaaagccgtgttcaggggttaaaggttcgccattatgcgaataagccagaagggaagtttccgctaagaaatcatcaagcggcagattggtcgtccagccctcttcagcatgtaaaatgacgtagcccgcttcttcttttacacccgctttttccgctatatcacaagcccgcacgccttgccacacattatcaagccttgaccatcccgtgacgcaatgaatgtcgtttttcgattcataccgtggaaaggctttgacatcttcaaagcttagcagcatcggatggtcaaccaaaccgtatacttgaagattccatttcgtcatatcttcgtaatatgggacatctccggtatgaagcacaggaaatgaagtggtgacgttttgatttggcggcactcttccagattgatcggactgtcttgtttttccgaaatacatatggtcctcctttttgttaacctaattcaaaatcatgttgacaatctttttgttctttattactctatgattgtgtatgtcaacctaagggggaacaacgatgaaacaacgtaaacttcgtgcgggagatatggcgctgattggcatgttcgccgcacttatggctgtcggggcaaacattacatcagtagcaccctttttacaagtagccggcattccgctttcgatgcagccgtttttctgtctcttggcagctttgcttcttggcagcaaacgggcagcgattgccatgattgtatatgcacttgtcggattggccggagcgcctgtgtttgctcaattttcagcaggcttcgcaccgtttgcagggaaaagcggcgggtttattatctcatacattccggcagcatttgcagcgggatggtttttagaacgaaacattcagccaagtaaaattcgatttctcattgcttcacttatcggaacggcgatcatgtatctcatcggcactacctatatgtatcttgcactgaagctgtggattcatacgccagtgagctacggcacggcttggggctttatgatttggtttatggtaaaagatacagcgctggctgtgatactgtcgtttatcgcaccagcaatttaccgctctattcataaagcaaccggctttaacagaaatcacatatcatctacgtaaaaaccgttctattggacggtttttttatcataacgagaaaaggctccccagtaaaggggagcctttttcctataaaacaagcgctgcaatccagccaaagatgacaagcggaatattataaaatataaatgtcggcacacaagtatcccaaatgtggtgatgctggccgtccgcactcaaacctgaagtcggcccaagcgtactgtcactggcaggtgaaccggcatcgccaagcgcagcagcagccccgataatcgcaatcgttgccatcgggctgaatccaagctgcatgcatagaggcacgaaaatggttgtgataacaggaatggtcgcaaaagaagatccgatccccattgtaattaataagccgacaatgagcatcagcaatgcgcccaaggactgactgtgtccgataaaaccagctgacgttttgaccagtgactcgacatctccggttttcgtcaatacgtttgaaaacccggctgcaacaagcatgacaaagccgataaaggccattaaaaccattccatcagtaatcagtgagtccgcttcatcacgcttcatcacaccgctgacaaacagaacaatcagaccagcgagcgcccccataatcattccttctactcccaaagtctgagataagtaaagctggacgccgagtgacacaacaatggctagaaccgcaataccaatactttttctcgtatatggcgatgcttctgcacctgaaatgtcttttgtttcatattgtttcggtttacggtatacgatcactgataaaataaggccgacaaccatacctgcaactggaataatcagtgcgtacggaatatcagcaagcggaacgtttaacccggcatccgccatattgtccttcagcatgccttggaagatttggccgaaaccgaccggaagcaaaatataaggagccgttaagccaaatgtaattacacacgcgatcagacggcggtccatttcaagttcattaaagattttcaaaagcggcggaatcagcaccgggataaacgcgatgtgaaccggaacgacgttttgcgaaaaacaagatacaattaaaataatcagcacaatcagcaccttagacagtgctttttttcgagaatcttctttatttccgattaatttaacggaggcttccaccattgcgtccggaagacccgttttcgtcaaagcggcggcaaacgcgccaagcatggcatagctgactgcaacggtggcatttccgccgagaccgtctgtgaaagctttaaccgtttcgccaagaccgagcccgcctgttaacccgccggccaaggcgcctataattaatgcgataacaatattgacacgcagcaggcttaatacaagcataagcaggactgcgatgacgactgcattcatgatgatacccctccaaaaatcctttagtttgctaatgtagtagataaataaagtacgaacgtatcgtatcataaccgatccactttagtcaactaaagatttcggaagaaaaaaatccctgccgcatcatacagcagggatttttcattactcgtttttatcttcttccaatgtaaatcgctccgcaagtgtagccagtgttcttgccataacgccagtagccccggccggcccgaagcaggttgctttattggcagtcgctgttcctgcaatatcaaggtgaacccaaggtgttgactcagcgaattcaccaagaaacgttcctgccataatcgcatgtccctcgcgtcccggtgaattgttgagatccgccatttggctgcttttcacgcgttttttatccttctctgttatcggcagctgccagattgcctcgccgcactcttgtgcagcatcagctacctgctggtaaaagctttgatcatttgtcattgcaccggttgtttcagttcctaatgccacaacgacgccgccggtaagcgtagctacatcgacaagaactgacgcgccatgctgtttcgcgtatgtaatgccatctgcaagcactagccttccttcagcatccgtattaaggatttctattgtttttccgcttaaagatacgatcacgtcatccggcttcatggccccgccggagatcatattatcggttgatggaataacgcacagcacgttttgctcaggacgaagctctccgatcgtttccatagcaccgagaaccgcagcagctcctcccatatctgatttcatgccgacaattccagatttcgttttaatggagtagccgcctgtgtcaaaggtaattcctttcccgactagtccgacgacgtcttcccattcctttttgccctgatatttcaacacaatcattttcggcggttcggtggagccttggtttaccgcaagtattccgcccataccgagctcttccatctctgatttctccaatatctcacactcaaaatcatatttcgccgcaagctcttcagcatacgaagcgaggtcagtcgctgtcagcatgtttcccggcatattcacaagcgttctagccgaatttgtcccttgtccgtatgcctggccgacgcgaagccctgcctgcacttcctgtgtatcttcatctgttacaacatacacggcttcaatttgtttgtcaggctcatttgatttgtgcttataatcctgcacctcataggaagcaagcaggcagctctcagctaaagcatgagcggcatcggctggaggcacgtcttccgaaataaacgtatcaagcagaacagcagtttcttgttttcgatctttatgaatggcttgaaaaacatgagcaaaacgttccttcgcctgttcaaacgaataatttgcttctctccccagaccaacgaaataaatccgtttcatacccgcagaagatggagggaatacttttgatacttgattcggtttcgcagagacatcaccctcttttaaaagctgtgtcagatggccttcgagcatttcatcaatttccaacgcttttcctgtcagctggcttttttgaaaaagcccgacaacaagggtttctgtatgctctgattgttgaaccgcataaaacatgaggcttacactcctaacgtaatgggtatttgtaatgaacaatggtataataggaaaaacattctttccactatacttattttaacaaacaacagtctaagacttgcttttttcttttgaaacacgaaggatttttcaaatagaaaggatgtcgccgatggaacttttaacgaattttcctttattatcaagcctggccgcaattatttttgctcaggtcatcaaagtgcccatacagtttatcgtgtccagaaaactggactggtcgctggtcacaagcacaggcggcatgcccagctctcactccgcagcggtcactgcactttcaacaggcgtagccttggagcatggattagactcctcactctttgcggtttctgccattttcgccgtcataaccatgtttgacgccactggcgtcagacgtcacgccggtgagcaggcaacagtcattaataagcttgttattgattttaaccgtttcgtaaatgaagcgaaggacttccctaaggctgcagagaaagaaaagcaaaaaaagctgaaagagcttctcggacatcagccgatcgaagtctttttcggaggattaacaggtattttactgacattggcactcgcttactttttcatgtaaaaaaacgctcctgctttcgctggagcgttttattctttcacagttttatattgatttctgaacacttgcaaggattttgtttcattgagcttctcaagctcatcctcggtaatctttcccgttccctttttaatcacatatacatcaagggtttttttgccccattcattgtatacatctttgactgtctcaaagtacagatcaaggcggtttcccttaatagctgatcctgtgtcggccacaactccgagaccgtagttcggaatgaataaaattgttccgatcgggaaaacggacgggtcagcagcaaccgtggaatataaatcccgtttcactttcacacctgaatatgtaagcccgtataatggatcaccgggatttttgcccgtcgactcagctcctgctgtgtagcctgttgctgttactctttggactggatattcatcccaatcaaatgcctcttctaacggttttgttttatcctcagccgcggacgtggtttgtgtttgtttctgctgcaatgcttttaatgtcagtcctgcatgcttcaagtgcttttcctgatgttcctgcacccattttgacaagtccttcgcttcaattcctgacactgataaaaatgtcgtgccaaatgcaagcagaaataaacaggtcatcagcaaacgtctgatcatattcaacatcattcacctctcctccgaatcattgttcccaagtggagagagcattattcaaaatggtgaatgagctgaacgcataaaaaaagctttctttagaagaaagcggcatttaaaacatttgatatcctctttttctgagcatgttgatcgctataccggacacgatggcgccggccaaaccgctgactaaaatcagcacatcagcagccgctaatgataagacacgatgaaacaggctggcaaaggattctcccggcgactggacatagctgatcagcttttctttgctgataatgaaaaggcatacaatcggataaatcacagccataatccaagacattctcagcagcatgtttaataagaaaccgattccaaaaaacaagacaaaaaacaaaacaattgagatgattacgactggcagactaatcaacctattccaccccctgcgttgtttttagtgtaacgcgggggctgaaataaagtcaacggctggaaaaagaatgactgtcttttcctgtcccctggcaagacggacaagtctctgaaccgccgagaatcaattgaaaatatcctttccctgaacaaaatgggcatgcatgtgaagcggttgtcgttgcagttttcatctaatcatcaccctttttcttaattttctgataatataccatatcaagctgtcaacaataaagtcagatcatgtgacaaatcttttgatgtaagcggaaacatacttgttttcctctcgttctctttttattttggcgttttttaataaagaaaacccgcttccgcgggtttttagaaaaacttgaacttgccttttttcaatgtcagtccgagtccgccaatcataaacagtgagcggttatcaatgacttttttcataaacgaagcgggcgtgcctttcagctttctgccataaacaaccccaaccgcgttatgctcgccaagagaagccactgttcccttaatgtccggcttgaattcctcaagctctccgcctttaataagcctgccaaggtttttagcgaccgttatgccctgctgcattgcaatttgcgcagtcggcggatacgggcgctctgtatcttcattcataaacagcgagctgtcgccgagaataaagacattgtcatgtcccggggcgcggagatcagggttgactttgactcggccgcgcatattctcaaaaccggcttcctccacaatcggatggccgcggacacctgccgcccatacaacggtttgcgatttgatctgctctggttcttcatcttttttgccgactctgactccttctggtgtacattcttgtacagccgttccgatcttgaactcaactccgttttcctcaagataatgtacggcgtaatcaacaagttccggatcaaagcccggcaaaacggtcggcgctgcttccacacaaataatgcggacaagacttctgtcaacgtcatactccttacagagctccggcacgcgagcagccagctcgccaagaaattcaattcccgtaaatccggcaccgccaacaacgatcgttaacctgtccggccgtttttccgcttccgtattgtaagtcgcaaactgcagctcaatatgttcccgcagcaggcgcgacgtgttgatgttggcaatcggaaacgcatattcttttaagcctttaatgccgaacgtttcaggcacggcgccgagcccgatgactaaataatcgtactgcaattctccattcgcaagcacaacttttttctcatcaattttgattgcctttacggtatcctgtacaaaattaacccgtgactggttgattacatcttttatctgataacggcagcggtcatgatggagcgtacccgcgctcgcttcatgcatccatgtcgtttcataatgataattgtgtttatttacaagcgtaatgtcagcatcattcggcccgacatacttcgtcagccttgtcaccgtcatcaatccgccatatcctgcacctaaaatcacgattttgggcttattcaatgccatcacatccaccttctctttttttgcttttgttagacccataataaaatcatcatttgtgttagcttcagcttattggcgggattttatgaaatatattgaaaagttttttgtgaagtccttacccgtagcactattatcatgtttatccggctggcccaagaaacattcagaaaaagatcatttcatttggttattatcgtagcggcctgcggaaatattttcaagaacggatgggcacgttagatccttacgattttttctgctgactcgtcaatttgaacggcaatatggtataattaataacaattttcatttaggaggcaattttcgtatgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgcgcgcaagagcttatcaataacctaaaagagcaaatggcgaaattcgaccaaaccatttgtctggagcaagcggttgaatctgttgagaaacaagcagacggcgtgtttaagcttgtaacaaatgaagaaacccactactctaaaacggtcatcataactgcaggaaacggcgcattcaaaccgagaaagctggaacttgaaaatgccgagcagtatgaaggcaaaaacctccattacttcgttgatgatctgcaaaaatttgccggcagacgcgttgcgatccttggcggtggagattccgcggttgactgggcgcttatgcttgagccaatcgcaaaagaagtatcgatcattcaccgccgcgacaagttccgtgcgcacgagcacagtgtggaaaaccttcatgcgtcgaaggttaatgtcctgacaccattcgtccctgcggagctgatcggcgaagacaaaatcgaacagctagtgcttgaagaagtgaaaggcgaccgcaaagagattttagaaattgatgacttaatcgtcaactacggtttcgtttcatctcttggaccgatcaaaaactggggcctggacatcgagaaaaattccattgtcgtgaaatcaacaatggaaacaaatatcgaaggcttctttgcagcaggtgacatttgtacatacgaaggaaaagtcaacctgattgccagcggcttcggtgaggcaccgacagcagtgaacaacgccaaggcttacatggacccgaaagcccgcgtacagcctcttcactcaacaagtctttttgaaaataaataataaaaaaaggagcttgtgtctgcgacacagctccttttttatttgaagatatttatataattcaatgcagttcctacaaccagcgcaatcacaagggctgcgactacccagatcattgccataataatgcggtcctgaatcttttgggacttcggtgttttttcttcgttttgggccatcttattcgctcctttcccatgtccatgccataaagaaagcctggtgctgaacgaccatgctttgctgaacgtatatcattcgcgttttgatccgctctctaagaccattcgttaaaactatgatacctaaactcaccctgcatgacaagcttcggcacttgaccacacctgccagcaaatcataatgtttgacatcctaaataaaacagagtacattatagaaggcgaacatttcatatattatacttttaaatattcgtttttaggagtgaaaaccatggaaaacgtatttgattacgaagatattcagctaattcctgcaaaatgcattgtaaatagccgttcagaatgtgatacatccgtacgcttaggcggacgtacatttaaattacccgtcgttcctgccaatatgcagacgattatagatgagaagctagcgattcaattagccgaaaatggctacttttatgtcatgcaccgatttgagcctgagacacgaattgattttattaaagatatgaacgcacgcggcttattctcttctatcagtgtgggcgtcaaagcggaggagtatgaatttgtccgccagctggcagaagaaaatctgactcctgaatacgtgacaattgacattgctcacggtcactcaaatgctgtcattgaaatgatccagcaccttaaaaaacatttgccggacagctttgttattgctggcaacgtcggaacgccagaagcagtcagagagcttgaaaatgcgggagcggatgccactaaagtcggcatcggaccgggaaaagtatgtattacgaaaatcaaaaccggctttggtacaggcggctggcaattagcggcgctgcgctggtgtgccaaggcagccagcaaaccgattatcgcggatggcggcatccgcacccatggcgacatcgcaaaatcaatccgattcggcgcaacgatggtcatgatcggttcactatttgccggacacgaagaatcgccaggccaaacgatcgaaaaagacggaaagctttacaaggagtacttcggctcagcctctgaattccaaaaaggcgaaaagaaaaatgtcgaaggcaaaaaaatgcacgtggcgcataaaggctcaatcaaggatacactgattgaaatggagcaggatcttcaatcttctatttcttatgcaggcggaacaaagcttgacgccatccgcaatgtggattatgtgattgtaaagaattccatttttaatggggataaatattaatcataaaaaaacgccaagtcagcgattctccgcttgagttggcgttttctgctactgcttcagcaaagtaagcttatatttgctttttgaatttattttccatcagttctgccatttgttttgcatttggattttcttcattttgcaaatgttcaatgacgttcatataatccgtttcatttcggttctggcttaatttatatgccgcttgaatatcttccaccttaatcttaaatccaacgatacctttcaattcacgttctaagagttttggagaaagcttatcccataaaacaggattgtcacgatgtttttcgtatttctccagcatgattgttaattcttctgctaattcatctttctctaacatacttgcttttccatacatgtggacagcctgataattccacgtcggaacattttcgcgtgaataccaggaagaagaaatataagcgtgcggtccctgaaacatcacaagcacatcttcacagacttcaaacgttctccactgaggatttccataagcgaaatgccccgtaatatagtaatgatcgtcttttttattgaatcctaaaggcaaatgtgtggcaattggttttccttgttctgttgtgacaatcgtaccaaaggagttttcttgtacaaaattccaaatttcttcagcatttgtgactttaaaatactttggaatatacatcatcatccacccttcgaaaaatattatatgagtgttttagccatgattaaatccgtttgctcttcatcacccatataaaaagagtgggcgccggtctgaacaaaccccattttcttataaaaggcaatggcattttcatttttttcccatacacctagccaaatgttctttttattacgttccagcgcaatttctatagctttattcagcagatgtttgccaagcccatgtttttgaaagctgttctttatataaattctctcgatttcaagtgattcagcacccatttcttcagactgagcatcatcgatattgacctttacatatccagcgatttcatgatcaaagtaaacaaaaaagaattgcgaagacatattggataactctttttccagctgctcagtgttaaatgcgctttctaaataggctttcatattttcaggtgagttctgttctttaaaagtgtcattgaatgtttcaatactcaattgttgaagtgtttgtaaatcttcccggctgcattttttcatttttacactcattgttcggattcagcccctttattttaaattcaattgtctagtgtcccttttatatatttaaacacggaacagatactgaccttgttaccattccaaaaatcttcttcatcaccaactccctatcgtgattttgttgtaaatgcaataaaatatactccgcattaaatatagcgtaactttgctgtatttacaacaaaaatcaaacaacaaagcagcgtttctcttgcctaagtccccgtactctctgcatcatttccccataataaaaacgcctcccttaacgatgatttatcgctaagaaaagcgtcagtaatagttgctatccgtttttagtgcttagcactcttcaggcttgcctgcattcgttgctgttctaaacgaagaaccgcagccgcatgaagcgatggcgtttggattgtcgatggtgaagccgccgccgagcatggattgtttataatcaatcacggtgccgttcatgatgtcaaggctttctttgtcaactagaacagtgatgccgtgctgatcaaacacactgtctgattcactcttttcatgctcaaagcccatgccgtaagaaagtccgctgcagccgccccctttgacgcctacacgcagaaacgcgttttcttcttcatgctctttcatcatatcttttatatgcaaagctgctgcttctgtaattgttaccgggttgctcatcattgtgaacctccttttaaaaaccggttgctgtcttttattataaacatgatcgtcccaattctcaaacaaggtgttttacaagaaatagacaccctcacaaacggtttcagccggccctgtcatcattacatggccgttatctttccagtttatcaccaaatccccgcctgctaaatgcaccgtgatgtcttgatttcgctttgatacaccgtttaatacagatgcgactgccgctgcacatgctcctgtcccgcatgcctgagtaatccctgatccccgttcccagacgcggaaatgcaattcttgttcattcacggtttcaacgaattccacattgatgccttccggaaatctcggatctttctcaatcaccggccccagtgtcgttaagggtgcctgttcaatgtctgcgatcggaaaaacgatatgcggatttcccattgaaacggcagtgcctgttagttctacttcaccaaatgccatcgtttcattgattgtgtgctcttcccgccgtcaagcatcgggagctcggatttggtcaagcgcggttcgcccatatcgacagtgaccacattcacttttccgttttcgacttgaacctccgctttcacaagcccggagagagtttcaatcagaaaagatgtttcctcaaccagcttatgctcatatgcgtattttgcgacgcagcgcagtccgttgccgcagtttttcccttcagacccgtcattattaaaaatccgcattttaacaggcgcttggtctgatgggcatatcaggatcattccgtcggatccgatccctgtataaacagaagaaacctgaattgcaatctctgacagtttttcttctggaagctgttcttcaaattgattcacataaatataactgtttcccaggccgtgcattttgataaatcgaaatgagttcataggtgcctccaactttttttctttttcttagtataaaagctattataagcggacacaatacaattatcccccgtttttcatacataaaagctccttgcactgacgcaaggagcttttatcgtttatataaacatgccggcaatggctgcgctgagcagattggctaatgttcctgcaagaacagccttcagaccgagacgtgcgatatctgaacggcggctgggcgctaaaccgccaagcgtaccaagcataatcgcaattgatgaaaaattggcgaatccgcataatgcgaaactgataatggtagcagttttcttagaaaactcgccgatgtgcggaccgaagttagaataagcgacaaactcattcagcaccaacttctggccgatatagcttcccgcctgcaatgcttcatgccaaggcacgccaatcaaaaaggcgataggagaaaacacatagccgagaatggattctaatgttacgccttttaaaccgaacaagccgaaagccccgccgagaataccgtttactacagcgattaacgcaacaaacgcaagcagcatcgccccaacgtttaacgcaatttgcagtcctgttgacgctccctttgccgctgcgtcaatgacgttggctgctccttcgccttcatccattttgaaatcgctttttacggtttgcgttttttccgtttcgggtataatcaatttaccaaagactagtccagctggagcagccataaagctggccgccagcaagtactcaatcggaataccgagaagcgcgtacccaaacaaggtagatcccgcaactgccgatagaccgctcgtcataatcgtaaacaactcagagcgcgtcagtcccgcaatcaggggtttgatcactaacggagattctgattgtcctacaaaaatattggcagcagccgccagagattccgttttgcttgttccaaggagcttcgacaatccgccgccaatgacacggaaaacgagctgcatgattttcaaatgatataaaactgcaatcagtgctgagaagaaaatgataacgggcagtacacttaatgcaaaggccggactgtctccgacctttagaagcggtccaaaaataaaactgatgccttcattcgcatagtcaatcagaagctgtacacggcttgaaaaccataaaaaaacagcgcgtcccgcttcccatttcaacacgatgtatccaaacgccacctgtgtgcataaaccaacgatgacgattcttatcttaatattgcttttcttttctgaaaataaaaacgcgatagcaatgatcgcaactgcgcccagcagcccccacagaacattcatgaatactcgtacacctcttaaattttatttgaaaaaatatcttttatacgataacaataatattttttgatgtctacacatttttttagttcttttgtacggcaaaataaaaaagggcctgtccaggcccttttctttaaaacattggattttcttcaataaaggtatatatattctcaacaagctcagcaggcgtttcacccatgacgacttctccgtttaccagagcgaaaagcgattccatgcatgtcccgcagtagcttaagcagccatattcaaggacatcaaggttgggatccttctccaaaatcgcccgggcttcctgagagccgtgagccagattgctgacacaaaattcaatcattggattcatgcggtttcacctcacatatgtccattatcgcgaatttttcactattcgtcaaagacaacggatgtttcaaaatttattatcgtaacatattatttctcaaataacgttttactaatttgtgttttcaggctaaattgtaggttattttgaaactattattgtgattttagatcaaattcgatataattctagatgttattttacatagttcgtattttcttcaatgtatctatcatactcttcggattaaaggggaattcaaatgaaaaaattggtcttgatcggcggaggttacgggaacatgcgtgttcttcatcgcttattgccaaaccagctgcctgatgatgtttcaatcacgttaattgacagaaatccttatcactgcttgaaaacagaatattatgcccttgccgcaggcacaatttctgaccatcatatcagagtgtcattcccagagcaccctcgcctggatgtccaatacggtgatatcacatcaattgatattgtacaaaaacaagtgctgttccaagatcgtgaaccgatttcttacgatgacgccgtaatcgggctcggctgtgaggataaatatcacaacgtgccgggagcgcctgaattcacctacagtattcaaaccatcgatcagtcccgcgaaacctaccaaaagctgaataatctgagcgctaatgccaccgtcgccattgtcggagcgggcttaagcggtgttgagcttgcaagtgaattgagagaaagccgtgatgacctgaacattattttgttcgaccgcggtaatctcattttatcaagctttcccgagcgtttaagcaaatatgtgcaaaaatggttcgaagagcacggtgtccgcattattaacagggcaaatatcacaaaagtagaagaaggcgttgtgtataaccacgatgatccgatttctgcagacgccatcgtgtggacagccggcatccagccaaacaaagtcgtcagagacttagatgtggagaaggacgcacaagggcgtattgtattaacgcctcatcacaatcttccaggtgatgaacatctgtacgttgtcggcgattgcgccagccttcctcatgcaccgagcgcccagctggcagaggctcaagcagagcagattgtccaaatcttgcaaaaacgctggaatggagaagccctgcctgaatcaatgcctcagtttaagctgaaaggcgtcctcggttcactcggaaaaaaagccggcttcgggcttgttgctgaccgtccgctgatcggccgtgttccgcgtatgctgaaatccggcttgctgtggatgtataaacaccataacggttaatgatagagaagaaccgctgatcaagtcagcggttttctgtatacccatgcttctccatttcctcataaacgtcttttaattttggattgccttcaccgacaattttgtcttctacgagcacaagcggataaaaatactcgtcatttctgattttttccgcaagctctttcgcatgttcattgtcaggcggctcataaatatcgatgtactgcatctcaaaaggctgatttggatattttcttttcagcgcagcctcaagccactcgtatgtatccttggctgtcggcatattgacacagctcgcacacacggtttctgccccatatacgcttagcatgactggtttcatcacttgttaacgcccccttctcctatgcaagtcctttcgtcctttcttttaagtatacagagccaaaggacatttttatagaaaaaaaccgtttttgtgttgaggtctgaatgtgctataatagggagagcaactttgcaaaccaaacaatagatttttattgttacactgaatataatggttttatgacgacgaaaggagcgaatgtcatgactgaagttgaaatgaaagaacaggtgcaggaagtactggacaaacttcgtccgtttttacttcgtgacggcggtgactgtgagcttgtagacgtagatgaaggtatcgttaagcttcgtcttctaggcgcatgcggcagctgcccaagttcaacaattacgctgaaagccggaattgagcgcgctcttctagaagaagtgccgggtgtcgttgaagtagaacaagtcttttaataaagcagccaggctgatatttgatcagcctggcttttttattagagatattggtcaaaccatgagctgatataattcaggcgcttgatccgctgtcttgggtgtccggtgcgtgacaaattgtgcgatgcattcggaaaacggacaagcttggtttccttgcccatttttttcagagcgataaacagctgctccgcctgctcgatcgggcatcggtcatcccgctcgccatgcagtatcaaaagcggtgtctccacgtttgctgcgtattttaaaggagaccggtcccagagcttttctgtgtcctcaaacatgtcatgctcaagctgccagtctgtaaagaaatagccgatatcactgacgccgtgaaagctgatccaatttgatatcgagcgctgggtaacggcagctttaaagcggttcgtctgcccgacgatccagttggtcataaaacctccgtagcttccgcccgtgacaccaagccgcttaggatcaatatgcggatctcgcttgatagcctcatccacagcctgcatcacatcggcataatcctttcctccataatcccctctgaccgcattcacaaattcctgcccgtagccgtggcttcctctcggattgatataaacgaccgcgtatcctttcgccgccagcacctgaaactcatgaaaatatgtatgtccgtacatcatatgcggaccgccgtgtatgttgagaataagtggatacgttgtctcaccttccatttgtgcaggcttcatcagccagccgttcaccatcacgccgtcttctgtagtatattgaatctcttcaggtattgatatcgtatgctccctgacaaacttgtcattcgcgccagtcagctgtttctcttcctgtccaagcgggatactgtaaagctcactcggtctgtccggctttgtcacactggcaataaagtgctgttcatcaggtgaaagagaaaagctattgatgtactctttttccagacgaaccggatacacaaggccttcaatcgaaatataatagatgcccgtgctgccttgatctgtgccgatgacataaaacccttggctgtcctttgtccaaatcgggcgctgttcagcaccaccgatcaatgaatctccaatcagcgcatccgctaaatgaacgtccagcatctcagtcagacatgtgaggcggccttgttcgatatcatagagccacgcctttgagagcgttgcattctgatattccttttcatttccaagcaaagcaagataccttccgtctggtgaaaatgaactagatccgaatgagccgcgatgaggtgtaacctgcttaagatctccagactccagtgacattatgtaaacatcatgcggcttgctggcatcatctgtttcagttaaattagctgagaaaacaagccatttgccgtcaggagaaaaagcaggatcaccatgatcagctttgtgacttgttagctccttcatctcacccgactttacgctgacaagcacaagctgggcatacgcacctctcgtcagccctttgccgtcccgtttgtaggagaggccttgcacttcaacaggttcatagctgtcctgctctgttttttctcggtcatcaatgctttctccctctcccaaactgacagtgaccagaatcgattcgccatccggggaccatattggctttgacacgccatacgggatatcagtcagttttcttgcttctccgccttcagtgctcatgatataaagctgtgccgcatcgccttctcgatcagaaataaaggcaagcgtgcgcccgtccggagaccatcttgggtcggtgcttcgcttttctccatgtgtccaaggaacagatccgcccgttttcgtttcatagatccatatatttgatgtatacgaatctttctcttgattcacttgtgattttacatatgcggcacgggtgccgtctggggcgtattgaggatcggtcacagagacaatcgctgtgatgtcgtctgcggttatcagctttttcatattcatctcctcctttttacatgtatttcgtttttctaaataaaaactcctttatctccagcaaaaaaagcgccctctgctgacgctgaggaacgcttggcatgatctatacactttttacttgatataaaggatttcgctctattatacttccctctttcgggacggtcaaagcgtctacttcacaatgagggaaatgaagcgcgagctgttcttttagctcttctccctttcctttttcggtcatgacgagaatcgtcgggcctgctccgctgagagccgttccatatgcgcccttcatctcggcgacgtgctctacttttgacagctcaggcacaagcatcgcccggtacggctgatggaacatatccttcttcatgattttcccgacaagcggccaatccttggacatgatcgcagcaatgagtatattgctgacagcacttgcttttacggcatcggcatatggaaactccttcggaagcacgtctctcgcgtctcttgtcagcacttcgtaaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactggctaaatgcagcttgtccgcttcagacagctttaagccgcataattcatcagccagttcaatggccgctacaatcgccgcggcgctgctgccaaggccgcgtgcaagcgggatgtcgctccacaccttcacatggacaggaggtatttcttttccgtacaaatctgcggtccgtttagccacttgatagatcaggttatctgtacccgccggaattccggcgactgtttctgtttcagcctcaaaagaccatttgtcgctttcaaagacggtcagcttcaaatatctgctgagcgccattccgactgaatcaaagccgggcctaggttagctgtgcttccgggaacagtgacagagaacagcatgtcggcttcgttcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacccggttctgcaaacacgccttctacacgggcgatcagctgatatgcgtgaaggatttcatcatcagtgacttcgtcaattttcccattggattcctcggctgcctttacagctttgtcccagcttgccgggtttccgatacgaatggctgtcgctattgtttcaggattttcaatcacttcattgcgcacgattgccgccgcaccctcagcttcaaagccacgcattttcggaaggcctgtgccgtttttctcatgatattccttgaagcccttccagtacgcagtgatgtttcccgcgtttccgaccgggatcgctaaaacatcaggcgcttcccccagctgttcgcacacttcgaaggcagcagttttttggccttcaatgcggtaagggttgactgagttgacaagggcaatcggtgatttctcacagatggaacgaacaattttaagcgcatcgtcaaagtttccgtcaattgcgataatctcggctccgtacatgacagcttgagcgagttttccaaatgcaatttttccgttcgggatgatgacaatgcatttcatgttagcacgggctgcatatgctgccgcagcagcggaagtgttacctgttgacgcgcacataatcgtgtcattgccttcttcttttgcctttgccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgatggataagtcctttccacattagctccaaccgttcccttctacacgatatgtgcttttgacttcttgaacgacttccaaatcatttaggttttgcaggatatcactgaaatcagcttctgatgtatgatgtgtgacaattacgatttcagctaactcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggcccgacaaagctgttgccggttacaccgaggcgcatatttttcatgacagcgacgaggtcagaaacaacggatgtcgctgtcggcatgcttccggctcccggcccgtagaacattgtctcaccgacagcctcgccgtatacataaacagcgttaaactcattatgaacagcagaaagcggatggtggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacgtcagaagtcggatcagcttcggcaaaaccgagatcctgcgcttccttgagcacttcctcatatgggcttttctctttgatcatttttgttaagataaagtttgttgtgccgttcacaattcccatcatttttgtaattcgatctgatgagaggccttcctctaacgtgcgcagaatcggaatcccgccggcaacactggcttcaaagtagatatcgcatccattttccttcgcttcggcaagcagctcggagccgtacacagccattaagtccttgtttgctgtgacaacatgctttttcgatctcagcgcgtcgaccaaatattgttttgtctgctcaactccgccgatcacctcgataacgacatcaacatctggatcatcaatgacatcatacacttctgtcgtgagcacttccttcggcaaatctacttctctctttttctctatatcttttacaagcactttttttatcgtaaccggacagccgacctgatgcataagcttatcctgatggtcttgaataattttaacgacaccgcttccgacggtacctaaacctaaaagccctacacgaatcgctttcaaaaaaactccacctttcttttgattgtcctcttgaaaaagacaattgttaactcaacacagacatataagttacaaacattatataagcccgctcctgttttgacaagacagcactaggctgaattttgcgaatgtaaacgcttaacgcattgatatgacaagattctttattttctaattatttttgtcagattttctcctcaccctgagctgcctttgccgagccagctgacgcgtggaacaaacagcttctgcgcccgcatattcatgaattcctgcgctgtattgagaaattgttcataacgcccacagtcattaagaatgaagtcaagttgttcttcaaaataatgcttttctgattctgatgacatgtaatagctttctacgatttcaaaataatgaagcgggaaaagcagacggctgtataaaaggcgttttgaaaacgaagacagcggtgtgacttgctcgtattcctgtaaaaagagaaagccctgctgattaaaatcttgtctgtgatgcaaaaacgtatgcctcatatattcagccaaatcacgggaagcgtggtcaaacacccaatccgccggaatcctgatcaatgattccggtgaccatgtatgcctttccatccgctgatggcatatcgttcctgaatcagcggcttggggcttgtcatccagctcagtgtccactaaatattgtatcgcgttttctgacagtcctaaataatagggaaatgattcgatcatttttttatcgaatggctcatgcggaggggtctgaacctttctctgccaaaatgcttccagctgatcaattcgttttccccacagatccttccactggccgattcttccggctgccttcacctcatatggatatcctcggccttttcggtgaaattccgccagctccgctccaatggagaacgccctatttgaataaggggggccgccttcagcagagcgtacgtttttccctcatgttcaaatgtcagctcaccttcttttgtaaagataaaaaccgaaacgtatgggtcactttgttcttgtaaatactgactcatgtaataaagctccgccagctctgtttctgagaattgggaaacggggacaatcagaaagtatgaattaggcgtctgaaagcattgatatgtgtgctggtacatggaaagctgcctgatgtgaatgccgtatttttcttttattgtacctttcaccatgatcacctgcctgttgaattagggctcatcacatcgtagtcatacacagccggaattatgaatacatattttaatccgaagaaggcgcaagaaaaagtcgtaaacttctcaagcattttgtataaactagtaaaaaagattgggtgaagctgatgtcagaaaacgaacaattcagtcagatggaagctaaagcaagagcacggatgaaggagcgcggcgttgaggtatcagacattgccgagcttgtcttttttcttcagaaaaaatatcatccggatttaaccattgatgaatgcacgctgaacgtcaatcgtgttctcgcaaaacgcgaggtgcaaaacgcgattttaacgggcattgaattggatgttcttgctgagcagaaaaaactgtctgaaccgctgcaaacgatgctggaaatagatgaaagcctatatggagtagatgaagttctggcattttccattgtgaacatttacggatcgatcgggtttacgaactacggttacatcgacaaagaaaaacccggaatccttaaacgattgaatgataaatcaaccggtgaatgccatacctttttagatgacatcgtcggagcgatttccgccgcggcttcaagcagacttgcacaccgcgcgcggcatacagaataagggcacccttttagggcgcccttttttcaaatgtatggaatccattcagtcagagagtcaatggcgtgagtcggtttttccatatcgtctgtcatatgttctcttttcgttacgccggtgtgaacgagcagcgtatccatacccgcgttaatgccggccataatatcagtggcgtagttgtcgccgaccatgagtgtttcagacacatctgtgccgagaacgcgcatcgcctgctccataataattgattccggcttgccgataaatacaggctgtacacctgtagatacggttaacaccgatgtcagtgagccgtttcccggcagaagccctctttcagtcggaatcgcaatatctccgttagtggaaataaagcgggcgccatttctgattgccaggcagccgacagcaaatttttcgtatgtaatggaacggtcgataccaacaacgacaaagtccgcgttttctccgccaaatgtcaggccgttttcttcaatcgcctggcggattccttcctccccaatcacatacacagacgcgttttttttctgctgggcaatgtgctgggcagttgccatgctggtcgtgaagacctgctcttctgttgccggaatatcaaaagacacgagcttgtccgctacctgcttcggtgtacgcgaagagttgtttgtcacgaaaagataaggaacgccgcgatctttcagcgttctgacaaattcacacgcttcctcgattttttccgtgccattgtacatcgttccgtctaaatcaattaaataccctttatatgttttcatatccaacactcctgtggctttccagttgttatttaaacgcagaaacaggtcctagctctgtttccaaatagcttctgatccgtttcgggaagtcctgaagagctgtttgatgcgccttgatcagcctgtaaagctcgccgctgtcagcgagcagatagtgttgaaccaacgttttgcggtaggcgatcaatttcttgagctcagcaccctctttttccttgacaactttctcatcaacaagtatatccataatgtcgtcataactgcccgggtcccgcataataaagccgtcaatcatgtcattgcctgtatccaaaatgcattcgattaacagatggcctatacgctgaagtgccaattccccgattttagactgccagtctgtttgtgagtcaaatagcgccagctggtgctcgaagaaccctagtgttttctcgattttgcttctgtcaacaaaatacatgacagcatcccctttgtgtatatttattttctgatccgtttcaagacaaaatacgcacagccgaaattgcagtattcgtaaatatattcatctaatgtgctgattttcgtttcgaaggttgccttttgattctggtcgtcaaagaagcccttgagccttaactgaccgtatccccagtctcccacaatataatcgtatttatttaatatatcggagtagcgggctttaaaagcctcttcgttgaagccgtctttgaaattgtgcaccaattcaaattcggcattttgaataagaatcatgatctcacctctttttcactcattcctatcataattcattgccccgtccccatcaattgctaaagaataaatcatgcgatttggctaccctacacatgaggagggattgataaatgaaacgaaccgctgtcagcctctgccttctgaccggacttttatccgggtgcggaggcgcaggattggataatgcccaaaatgtccggaatcagacgcagaatcaaaccaaacccattcatgtgtcggaccgcaacgaggcttttaacaggcataatgagaacgaacaatttggctatgtccgctatcaaaaagaacaatttgacggagaccagcagaaaacgccggtgatgaaccgggaagaaaccgctcacatgatatcaagtttaacggttcagctcccccatattcaagatgctgcgacattggtgactgaccgagaagcgcttgtcgtatacaaaaccgattctaaaaaccgggagctgaccgccgatcaggtgaaaaaaacagcggcctccgtgataccgcgatactatcacgtgtatatttccgataatccaaaccatatgcagtccgtcgaaaattacagcaatctcggctctggttcaagggatatcagagagatcatgtcggggacgattcaagaaatgaaaacctccccgcaaggaagccctgtctcagagaatgaaaatgccaatggagaaacgcgtcaggacatgaaaatcgataggaatgacaaaaacgccagatgatctggcgttttggcattatgcttgtgcttgacgctttttagatgcttcgtttacttgttcatccgcatggtaagaggaacggacaagcggaccggcttcacaatggctgaagcctttttgcatcgcgatttcttttaattctgcaaattcatcaggatggtagtatttttggactttcaagtgtttcttcgtcggctgcagatattggccgattgccataatatccacgttgttcgccaagaggtcgtccattacttcaataatctcttcttttgtttcgccgagtccgatcatgatacttgattttgtcggaatgtcaggctgcatttccttcgcacggcgcaaaaattccaatgaacggtcgtacgtcgcacgcgcgcggactctcggcgtcaggcggcgaaccgtttcgatattgtgattcaggatgtctgggcgtgtatccatcaaggtttttaggttatcgtagtttccgcccatatcagacggcagcacctcaattgttgtgaacgggctttttctgcggatcgcacggacagtttccgcgaaaatgcctgccccgccatctttctgatcgtcacgcgcaacagccgtaatgaccgcgtgtttcaaattcataagcgcgactgaatccgctacgcgttccggctcttgcagatcaagctcagttggaaggcctgttttgacagcacagaaacggcatgctcttgtacaaacagaacctaaaatcataaatgtcgctgtacgtctgaccgcccagcattcatgaatattcggacactttgcttcttcgcatacggtgtgcaggttgttttcccgcatgagttttttgagccctgtatagttttcatttgtatttaatttaattttaagccattcgggctttctgaggtgttcgtctttctttgccaattcccatcatctccaatatccaatatactcaatttctgacacgaaacattctgaaaacgagaaaggtgcaggttttagttctgcaacaaaaataatgtttttctaactaaagaaagtcttttctttagacactttaacataggaaaaatttctcgacaagggaagatgattactgacatttttaagccgggttgccgcaaactatgtgtattcaatatgaaaggagattattttgtgaaagttttgttatccgctcttcttctccttttgtttgcatttgagccttctgcgtctggaaaaaaactttcagatccagtgctgtcgaaacggatggaattatatcataaaatcgaagctgtgacgcagatcccttggtatgcgctcgccgctgttgatcaatacgaggaaaacgtgcggagcaaccggaaagatctgcctgacaaggcgggaatcatcagcatctatatacccgatgacatttggagcgggcctgaaaacccgaatccgaaagacgatgcgccgttaagcattaaagtgtttgacggaatcggaatggatggcgatggagacgggaaagccgaggtcagcaacgatgaagatattttgtatacgttcagccaatacttactgtcgtatggcacagatgaagacaacatccggatcgggctttggaattattaccggcgtgatcagacagtggggatcatatctgaattcatgaagctgtttaaagcctacggccatattgatctgggcgagcatgcattcccgcttccgatcagaaccgattacagctatcgaagcacgtggggagatgcccgcggcttcggaggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaacaaaaagccgcctcttcaacaggcggcttatttgctgcttttttctttttttgaatcggcaccgtcttctttgctgctcggaagctggacagaaggcgtgacacccgagccgccgcttccattataaaactgcggcacttcgccctgcactgctttaatcgatacaggaacattatttgtgacgacagcggttttgctggcaaatggaatgatgaccttcactttaatttcgacaaagatgctgatatcaataagtgcgttatttatgccatacggcttgattttggttttgacatctgtaaaagcgtcaccgattaaattgaaccggaccgggattttcggcccgaggtttccaagaaggctgttgccggttacctgtcccagcggaatgttgatcataatgttttcactggcgccgctgtgtccggtatgggtttccatctctttcaaatgagcctgaagctgctttgtcacttttgttttcacactgtttacaacctgtgtattaaaatcgattgtcgttaagtttccgttttcatcagaattcatttgaaacatatctttcatattttcactgtcagacatatagtcctcaatcgaatcctggatcacctctgtcgctatacgcttcgtttccatctcgccgatgtccattaaaacaggtttgatcgagccattgatcatccaaaggctgaccgttgttgacaggataaaaaagacaacggacaggagcatcacgtaacggaaaggcaaaggtcctctcttgcgaaaagggccgcgatatcttggcaagaaaatccccccttacatatcacaatgtatgcttgtaagaggggacatagtaatagccggagccaatttattttatttcaccatttttaaaagcgcttctctgccgctcatgccgacttgaatgccaagatcttccgcggcgtacgtgacggattctaaaggtgcgtctaacagctggtcaatggtgcggacaccaactgcccgccccgccacgatgccgcgctcctttaatttttcattcagcagcgccacatcaagcgcgccgcacataatgtatccgtgatcattggtgacggccataaaattcgttttgggaagctttactgtcacagctgtaaaaggctgtccttctatcatgatcggtgtcaggtttaccacgtcaaccactcccttcattcatcactttatgatgaagggcacagcttgttgtgggctgactgccttattgcgcaagcttccaagcaagcagatcccgcaaaaattccggcataaaatattctttttctgcagcgtcgcgaatcagcggaaacagtttgccgagcgtaaacatatcaagcaccgcaacggagtattgtttatgtttttcaatatcttccccgttcagcgtgatccgggtgacgtgggtgatcccgtcatcgagccgtttcgtttctacctcaacgccggcatacaccattttccccatcacttctccgcggaagccgagtcctttgatccggagctgctccatttgttcggaagcggcatggacaatggtttccttcagttcttctcccgtcaggcggacagccaccgggttgatcggatgcggacagattcggtgcagatccaactttgtcacaggacctgctttaagcggaccgagaatgacacctgaattgaccatactgatgtccgtctcgcaccattcctttaaggcgtatgccaaaagcaaaggcagctctgattcttcaaaccacttcacctcagcatcttgtgcaagctctgcaacggcatcggacagcttctcctcggcttcacgttctttttcattgagaaacgcttttgtttctgcggattctcctgtccatttcgccatgttctgcacagaagccgttttgctgatgatgcttcgctgtacgctgtccaccgtgatttctacacagccgacataatgcccgtatttctcggcgctggccagcagtaccccattaaccacttgtccatcttcaagcaaatgatgggtatgtgattcgaggattacatcaatctcaggcaccgcttcagccactgcctgatcatcaagaatgcctaaatgtgacagcagaacgataatatcagcctgccctttcacttccagaatggtttcctttatgctttcaagggcatccgttactgtccaccccagcttgtcataaacaggataatacggcacagttacacctaagaaagcaatggacataccgtttttcaatgatttgatatggtaaggcaccgcccaggacggacggtttccatttttatcaaacagattagagacgatgacaggaaattcagcatgatcatataaggcagcaagctcttcatgcggaagcgtaatcccttcgttattgccgatcgccgctccatcaatgtgaaggcggtttaagagatcgacattcgcttttccgaatgtcgcctctgtcacgaattgaaaacgatctagatgatcgccaatatcaaaaacgagcgtctcttcgccgtctgactgatgctcttttcttttctgctcgatataatctacaattttcggccagttttcaaaatggctgtgcaaatcatttgtatgatataagcggagcttctccttcataatatctctccctaatcgttcagctgaaaatgccttcataaatgagctggcagccgatcaaaatcaatacgatccgcatgatcataacgatcgttttcgtctgcatttttctgttgatggcggcgccaagctttccgccgaaccaagcgccgggcacaagcgcgagggcgtacagccaattgacgtgcccggaaataatatgtgaaacagaccctgtcatagaagacaggaaaataataaacatggacgttgccaccgcaaccttcggcggaaacagaaataacagcatcatcgccggaaccatcagtgatccgccgcctataccgaaaagtccgcctaaaaaaccgacaacaaaggcgatcgcaatgccgacaggggcctgatatgaatacgtataaggctcgccagcatcatcctgaaatgtccgaataatgcctttgtgcgctttattgaccggccgggctttcgctttcagcattaaggataatgaaatcaaaatcataaaaatgccaaaccaaacggaaaacgagtttgaattgaacagctttgacacgtaagccccgatcatgctgccgggacccgaaccgataaagaaaatgagcccgctcttataatcaacggttttatatttaatataagccaaagttgaagaaagacccgtaaaaataatgaccaaaagcgaagttccaatcgcaacctgcggcgtcacatcctgaaacagctccgtcactgtgcttaaaaacatcagagacggcacaatgacaattccgccgccaagcccgatcagacttcctaccgtacctgcgattaatcccaggacgaccaaaatcacaaacgacatcagtaaaaacctcttttctaaaataaatcgagctgtctcggagcaagtccgctgtactcgatatcaagcagttcaagcatctgcttgccgttatccgcggcgtcaccgccggaattgttgttgaacagaacaaaaacatccttacattgctgctgcaattcattcaggtgctttttccaatcctccagctcctgttggttgtagcggtataagtacctgacctcccgccagtttttcccgccatcaggcttcatccagccctgcttgttgcgtccgtgaaatctgacgagcgttttgttttcatcggtcgcgcgcagcacagtcggaacgctgccttctccgatttgtggttcatcacagacactgtgaatccagccttccgctttcataaatgaaagcgtctgctcataaaatggcggcgagaaccaggaacggtttctgaattcaagcgcacaagggatatctcccatttggtgcttgcaccatctcaaataggcgacattctccttcttgcagtcaaaccacggcggaaattgaaacagcaccatggcgagcttattgctatgtaaatatggcgttaaagacaccttaaacgcatcaaacatctcctcttttgagtcaaagggaatttcgccgcgctgatgccctgtcatgccctgatatgctttcacgataaattggaaggtttcgggcgtttccttcacccacttttcattattgcgcgccggctgaatcgcataaaagctcgcgtctaattccacgatcagaaaatgggaggaataggcctgcaattttttctggctggccgttttcggcggataaatgctgtcatgatccccccatcccgtcagtccgatataaatcacactcattcacctctcttccagtttatcacacgtgttttcaggtttcctcggaaatgctgttcatatggcgggaaaatgcagaacgaagatgctgatattgttcctcattcgtatctaaaaacgcctcttctcttgaggaaggaatatgctgataatcaataggcgcctgaaactgctcactcgtaaaatcgaacatcacaccattgatgctgttgtaaaaatgccagctctcaccgacttttgttttgaaaatcgtgccgccgaaatggtcttgaatcaccaatgccgtcacgccgcattggccgcatgacgggcattcttccgtccatttagagctcgtatggcgcgaccaggattgcttaagtatgtatttgacatgttccattgcctccgcctcctttaaaaaaagataccacgttgatgagattttaaaaactagaacggaggaaatcaaaaaacccggcggtaaaatccgccgggcttacgaaggaacgaccagagctccgtcaatttcagtgactttttccccatcattgtacacgcaccggcctttgctgtaagtggccgaaatgctgcagggaaatgtatgtccttcgtaaatgctttttttatgctttgcaaacatcgattctcttgtaacagtgtacggctccatgctgacgagcacgaaatctgcatcacaccccgcctcaagccgcccttttttctgaaggccgaatcgttttgcaggggccgccgctgtccattctgcgatggtttcaaacggaatctgatgctcaagcgccagttccagcattcctaataaagtgaactgcccgccgctgattccgccccatgataaaaacatgttatcctcccgtttcaaggatagacggcagggggaatggtctgaggaaaccatgtcaatgtccccggcaatgagcgcctcgatcagcgcctcttttgattgccgtgaccggagcggaggcgcgcattttgcgacagagcccctttgccgtaaatcgtcatggctgaacaagacataatgcgggcatgtttcaaccgaaacatcaagaccttcctgtttcgcctctctgatcagccggaccgctttcgccgtgctgatatggacaaaatgaaccggacagcctgtcaccttcgcatactgaatcgtgcgatacaccgcttcaacttctgcttcctccgggcgggaggcggcgtacgcatccgcgtccacctttcctttattggccaaaaccatctgcaagtagcttgtgatcgcgtcactttccgcgtggagagcgaggatttttcctgcagccgcgatttctgccatgcctttgagcaatgtccgttcatcaacagagcggaactcatcagtgcctgactttgataaaaacgctttaaacccgatcgctcccgcttcagccatcggacggatgtcctcgatatggcctggcacaaggccgccccatagcgcaaaatccacggcagatttttgcctgcctagctcagcttttgagagaagatgctctgccgtcacggttgatggaatacagttgagcggcatatcaaaataggtggtgcagccgcctgcggccatcatttgagaacctgtttcaaacccctcccaatcctccctgcccggttcattaaaatgaacatggcagtctatcacaccaggaaacacgtatttcccgtctgcctggatgatttccgtcccgcttgcttcaatgtcagaacctatctcggcaatgacaccgttttgaactgcaatatcagcttctataacgccatctggcgtaactgccttcgcaccttttatcaccatatcgtaagccatattgatccccccatataaggataatgatttttcatgtcagtttatgtcacacaatcagttctattttccacagtttactgctactatgatcgtattacatcagcaaaaccgctagaattcctattgaaaattattcaccttaaccaatgtttttatagaaaaggagaatgcgctatgaatatttttgatgtgatgaaaataccggcttttgaaaacgccaatttaatcgctggaaaagcaggaggggaaagagaggttcagcatgtcaatatgatggacgctccggatatcgcagactttttgcataagaatgaattgctcgtcaccaccgcctatcacctgaaggatcacccgcatcaattatctgaactgattcggcaaatggcaaaacgcggctgcgcgggcctcggcattaaaacaaagcgctatctggaagatatcccgaaggaaatcatcgaactggccgattcatatgcgtttccaatcattgagcttccggaacatatccgactcggcgatattgtgaatgccacactcagccatattctcgatatgcgttctaacgagctgcagcaagccatttacgcgcataaaaaattcacaaaccacattatgagcggcaaggggctgcaatccctcctcaaaaaggtgtcagacctccttcagcttcccgtgctgctgcttgaccagcatgccaaaatgctgtctgcttctcatcagatttcagttgagaccgaaaagctgaaaggcaccctgaataccgtatccgggccgttttttacttgtttctctacaatctcagatcagaaaacatattctgtcctgcctatatataatcacgaaaaaaactgcggctacctgctgataccggacatggtgcaggcaggcgacaaaggattgatcctcaccattgaacaagcggccaacgtcatttcctttgaactgctgaaggaaaatgcgctgaagcagttcagccggcgggcccgcaatgagtttttcaacaattttattgagcggtccttttcttcagatgacgaaatcaaaaaccgggcgaaagaattcaagctgcgctgggatcaaaaatacatgtgcattgccggcaaactcgatcgcaatgacgaatcaatcagctttacagaaaatcagctcgcttccgacagcgtattcgaatttcttgaaggtgaattatcagccttcccgtttccgcctcacttctttatgaaaggaaatgtcggcattattctaatcgaggcgacagacagctggagtgaaatgcacgcctcggtgatcagctttttagaacagtttcaaacacaggtcagcgctcaatttaaacgaaccgtgtcctttggcatcagcaatatctgccaaaagctcattgatgttcccgacgctttcacagaagcttctgatgccctgcaatcggggcatttgtcaagaagcaccgcatttatccaggtgtatcacgccaaagatgtgcctgagcttctgcgcttgctcccggttgaggatttgaagaaattttacaactccacgcttcagagcctcgctgaaaaacagcaggaggatcaaagcctgcttcatacgctttccgtctatttagagacacactgccaaatttcagagacggcaaagcgtctgtacgttcatcgcaatacggtcatataccgccttgaaaaatgcgaagagctgctggggaaaagcttaaaagatcctgaaacaacgatgcgtttgcggcttgccttacgtatgcagcggctgatcagctaatatttgttacattttcttacaaaatgaatcgtttttcgtcactttcagcaatcacacctgtctttttcagctactgtatccaatgacacccctcgatcggcacgatatcatgttactaaagttcacatacaaggagggactatagtgaaaaaaagatcgtttaaggtgtttacgcttagcctgcagcatgtgctcgccatgtatgcaggtgcgattttggtgcccctgcttgtcggcagagcgctgaatgtaacaactgaacagctgtcctacctattggcgattgacctgttaacatgcggcgtcgcgacgcttttgcaaaccttgcgcggagcatacatcggcatcgggcttcccgtcatgcttggcagttcatttgtggccgtcaccccgatgattgcaatcggcagcaattacggcattcacgcgatttacggttccatcatcgcggccggtgtgttcatctttttgtttgcgcgttttttcggcaagctgactgtgttatttcctcctgtcgtaacaggtaccgttgtgaccttgatcggcctttcacttgttccgacaggtgtgaaaaatatggctggcggcgaaaaaataaacggcagcgccaaccccgaatacggttcgctcgaaaaccttcttctctctgtcagtgtccttgttctgatcttagtcctcaaccgctttctcaaaggatttgcccgaacactgtccgttcttatcggaatcgccgccggaacagcggcagcagcgatcatgggcaaagtcagcttttcttctgttacagaagcaccgttcttccaaatcccgaagcctttttacttcggagccccaacgtttgaaatcggtccgatcttaacgatgctgatcgtcggaatcgtcattattgtggaatcaaccggcgttttctatgcaatcggaaagatatgcggcagacctttaactgaaaaagacctcgtcaaaggctatcgagcggaaggaatcgccattctcatcggcgggctgttcaatgcctttccttataatacctttgctcaaaacgccggcttattgcagctgaccaaagtgaaagcaagaaacatcgtcgttaccgcaggctgtatccttgtctgtctcggactgattccgaagattgccgcccttgcatctgccgttcctgctgctgtacttggcggcgcgaccgtcgtcatgttcggcatggtgattgcctccggcgtcaaaatgctcagcacagcggatctcacaaatcaataccacctcctgaccatcgcatgctcaatcgcactcggcatcggcgccagcacggtccccgggatttttgctgaattccccgctccgatccggattctggtcagtgacggcaccatcactggaagcctgaccgctatctttttgaatctatttttcagcttgcgcggcaaaaaagacaaaacagctcagaaaacagaacttccggtattagaacatacactcgtattagaaaaagaggtgtaaaaaagatgaaggaacagcacaatgccttacagctgatgatgctggggcttcagcacatgcttgccatgtatgcgggagccattctcgttccgctgatcgtcggagcggcgatcgggctgaatgcggggcagctgacgtatttaatcgcgattgatttgtttatgtgcggggcggcaactcttttgcagctctggagaaaccgatatttcggcatcggcctgcccgttgtgctcggatgcacgtttaccgcagtcggcccgatgatttccatcggaagcacttacggtgtcccagcgatatatggtgccattatcgccgcaggactgattgtcgtcttagccgcgggcttcttcgggaagcttgtccgtttttttccgcctgtcgtaaccggatcagtcgtcatgatcatcggcatcagcctgattccaacggcaatgaataacctggccggaggtgaaggaagcaaagaattcggctcactcgacaacgtactcctcgggtttggcgtcacagcttttatcttattgctgttttatttctttaaaggctttatccgctccatagcgattttactcggtcttatcgcaggaacagccgctgcatatttcatgggaaaggtcgatttttctgaggttttggaggcgtcttggcttcatgttccgtctctgttttatttcggaccgccaacctttgagctgccggctgttgtcacgatgcttctcgttgcgattgtcagcctcgttgaatcgacaggtgtttactttgcgcttgcggatatcacaaaccgcagactgtcggagaaggatctgagaaagggctaccgggcagaaggccttgcgattttgctgggcggcttatttaacgcgtttccttatacagctttctcacagaatgtcggcatcgttcagctttcaaagatgaaaagtgtcaacgtcatcgccatcacaggaatcatactggtcgcgatcggcctggttccaaaagcagcggccctgacaacagtgatccccaccccagttctcggcggcgcaatgatcgtcatgttcggtatggtcatttcttacgggatcaaaatgctatccagcgttgaccttgattcgcaaggcaacctgctgattatcgcctcttccgtcagcttagggcttggcgctacaacagttcccgcgttgttttcatctcttccgggcgcggcctctgtcttggcaggaagcggaattgtgatcggcagtttgacggccattgcactgcacgctttttttcaaaccaaacagccgaatggcacagacataaaaacgtaaaggaagatgccaatgttcacaatggatgacctgaaccaaatggatacacaaacactgacagacacacttggctctatttttgaacactcttcatggattgcggagagatcctcagcactacggccgtttacgtccctttctgatcttcaccgcaaaatgactggcattgtaaaagccgcggatcgcgagacacagcttgatttaatcaaaaagcatccccggctcggaacaaagaaaacaatgagcggtgactcggtaagagaacagcagaacgcggggctcagcaaattagaacagcaggaatacgaggagtttctcaagctgaatgaacactattatgatcgcttcggctttccttttattttagcggtgaagggaaagacgaaacaggacattcaccaagcccttctggcaaggcttgagagcgaacgagaaacggagttccagcaggcccttatagaaatttaccgaatcgcccgctttcgtctggctgacatcatcactgaaaaaggagagacgcaaatgaaaagaactatgtcttatggcaaaggaaatgtatttgcataccgaacgtttttaaaaccgctcactggagtgaagcaaatcccagaatcatcttttgccgggagaagcaataccgttatcggcgtagatgtgacatgcgaaattggcggagaagccttcctgccatcatttacagacggagacaacactctcgtcgtggcaacggattcaatgaaaaactttatccagcgccatctcgcatcctatgaaggaacgacaaccgaggggttcctacactatgtagctcaccgatttttagaaacctattctcatatggacacgatcactctgactggcgaagacattccgtttgaagcaatgcctgcatacgaggagaaagagctcagcacaagccgcctcgtcttcagaagatcgcgtaatgaacgaagccgctctgtactgaaagcagaacgaagcgggaataccataacgattacagagcaatacagcgaaatcatggatcttcagctcgtcaaggtgagcggcaactccttcgtcggcttcatccgggacgaatatacgactcttcccgaagacggcaaccgcccgctgtttgtctatttaaacatcagctggcaatatgaaaatacaaatgacgcatacgcttctgatccagcccgctacgtcgcggctgaacaagtccgcgacttggcgagcacagtttttcacgagctcgaaaccccttcaatccaaaacttaatctatcatatcggctgcagaatattagcgaggttcccgcagctcactaatgtcagcttccaatctcaaaatcacacgtgggatgcggttgtcgaagaaatcccgggctcacaaggaaaagtctacaccgaaccgcgcccgccatacggtttccaacattttaccgtgacaagagaagacgccgagaaagaaaaacagaaagccgctgaaaaatgtcggagcctgaaagcctgatgggaaaactgacaacccatattttagatttaacctgcggcaaaccagcggcgaacgtaaaaattgaattgaagcggctgggcgaaagtattttgaaagaggtttacactaacaatgacggcagagtcaatgtccctctgctggctggtgaagagctggtttccggagagtatgtgatggaatttcatgcaggagactattttgcgagtaaaaacatgaacgcagccgatcagccgtttttaaccatcgtcaccgtccgttttcacattgcagatccagatacgcattaccatatcccgcttttgctgtcgccgtttggttatcaggtgtatagggggagttaagaaggaagcccgccggtgaggcgggcttctatttgcacttcaataaacttttgatcctaggacagtatttgcagtaatcccacgcttagtgaaacaacagcttgaataaacattcaccaatatttttcaggataattgcctacgagaaaaacatcctgtagtcctttcatttataaatcggggtttcaaactaataagtcagctcttagcagccgagctcccttttccaatcctataaacagaccgcgttttttctcaaaaaaatactttgaagacaattgctgcggttttaatagtttagataatgcgttctctcttacacctttagacaaaatattcattttttcttttttagacttaaatctatgtcgaaaatgatcgtttggcatatcttatactatctccactaaaggaggtgacattatgggattctacaattctggtggatatagtggaaactctggttactcaaacggtttcgggagctccttcgctttgatcgtggtgctattcattttgttgatcattgttggagcagctatctttaattattaagtttaactttccttgcctccgccgtatccaacacctccctgtccgacagacgccataagaagtttttatggcgtctttgctatggattcactaatcattttctaatccagaagctatcaagttctacgagatttatcgtgtgttttcccacaacgcttctgcgacttgatcgcgctgtctgactgaggctaaaaaagtccggcttttaaaagccggactcccgtctacccccgttcaactctcttctaatcctgcaagctgaccgcataatcccgccatacccggtacaccggcacaaattccccgccagcccttcttctatatcttcgtcagaaggttgaggggtttcccgaaacagagctttaagcgcaattatcattcctggggtacagtagccgcattggaagcctccttcttccagaaaagcggtttggcagatatccagttcctctttttgtacgccctcgattgttgtaatggaatggccgtccacttggtaagccatggtcatacacgcattggccagttttccgtcgattaaaatagagcaggctccgcagcggccgattccgcaggacacctttgtcccggtcagctgaaattcctttctaagcaggtcactcagatgtgtcgtaggaacggcagcaacctcccactcctgcccattcacggtcatccggaactgttccttttttacaggaaatggcccggcctcttttacgtccattgcttcagcccctttctgtctatcgcttcaagcagctcttctcttgaaattggcagcttgtttatccagcatccgaccgcatcatgtactgcctttacaatcgccggagtgatggcgatcgttccaatttcgccaacaccgcgcggtccatatgcatcacccttcattagttcttctattgcgatcaccttcatgttaggaacgtctttgactccggggatcaaatagtgatctaaattttccgcggcataacggccgtccgtcattttcgcctcctccatcagtgtgtagccgagtgccatggcagcgccgccttcaatttgacctcgataaccctggggactgacaaccggacctgccgcaatagcgtgctcacaatctattaatttgacatcacctgttaacagatctacctccacctcaacggaagccgctccaaatgagtagaggaaatggccgcccaccacaggatcaggcgttgttggaaagtcaaatgccgtttcctctgccaaagggcctttttcagccagctccttatacgtcaccacgagcgcctttgtgtttttgtcacgcaagcctgcagcgccgggaataaggttttccgctgaacagccgttccattctgccgccctttttttcaactgagatagaaacggcttcttcaaacgctggatcgcgtgccacaccatgcttgtgccgcgggatgctgtggaggagcctgacttcggcacttttgcggtatccccaataacaatggaaatatcttctgcggcacaacccagctcctccatgacaatatgttcaatcgctgctagaatcccctgtccgcattcttcaaatccgaacgatgctgtgattttgccttcactcgaaagggacaaacggcctcctgccgcatccattcggccatagcccagcccgccgccgtgcattgtaattgccgctcccgtgcctctttgcagatacccgcagttccggctggttcttgtaagaatgggagatttagatatggcattcaacacctgcgccgctccgtcagttggtgcaattcgatgctcaagcggccccaagtcatgcggttttctgatattttttcttctcagctcgagcgggtcgatgccgagcatgccgctgagacgatcgagatgggtttcgagtgcaaatgtgatttggttgccgccaaagccccgaaattcccccgccaccccgttgttcgtaaatactgatattccttcagtccggatattcggaatacggtacggccccgcggcatgctcgacagaaaaatcaagaacagccggtccgagcgtagcatatgcgcctgtgtccgccacaattttcacgtcatgcgccaatagatttcccgaatgatccgcacccgtttttatcgtaatcttcatcggatggcgcttaatgccagaacgtacagattcctttcgtgtctgatggattttgacaggacgtccgcttttcagtgacaaaagcgcggcatacggctgaatattcagctcatccttccctccgaacgagccgcccatcggacttgacacaatcctgatcttctcttcaggaatgtcaaaaatacgggcaagctggaaacggtctttatagccgtgctgggttcctgcatacatcgtaaaacccccgtcgtcttccggaacggctacgcctccctccgtttccatatacgtatgcatctgccgcggcagctcataggtttcttcaaggagtgtgtcagatgcttgaaacccttcttccacatcaccgtttgaaaaaaatgcgcggtgcaggatattcccgtcctcatgcagtctttgcgcattcggccgaagcgctttttctggtgaatccatgacttccagctctttatactcaacttgaatcagctccagcgccgcttccgcgatttcttccgtttccgcagcaactgcggcgatcgcatccccgacataccgcactctgtcctcacataaaaccggctgatcagggatgataatgccaaatcggtttaagccgggaacgtctttatgtgtgacgacggcttgcacgccttccattttctcagcttttatggtgcaaaccgacacaatctctgcatgaggataagcacttctcagcaccttgccatacagcattcctggaaagctgagatcggtcatatatttcaattcccctgtgaccttaccccttccatccggcctgactcttgacggtttgttgatgatcatttattcccctccctcagccatcagctctgccatgatgacgttggcagcggctttttttctgtatgccgctgacataaaagcatctgaggaaaacggcagctcatggataagtgttttgtacagatcatgcgagtcccaccctggtgccatccatttcgcttcgctgtccaataatctcctaggagtgatatcggcatggccagcggcgaggcgaatgccgccgtctttcaaaaaacgtccagctgcaacagcagccgctcctgtaaaagcctggcgccttccaagcttgtgataaaatacacgctctccctccgcccgcgggatgatgacacgcgtgacgatagctgttctaaagtcttcctcaatgagccaagcgccaagcggcagcctgattagcttcttttgatatacgataagctcagcatcaagcacaagcagaagcggaataaaatcaccgattttactggctatgttgccgccaatcgtggcacggctgcggattcccggtgcggcgacagcggaagcagcgtcactgaaacagccaagcgcgctcttgatcaaagggttctttctgcattcattcagtgatgtgagcgccccgatcgacacgtgggtgtcactggcgctgatccctcgcatctcgtcaatcccttcaaggctgacaaggtgctgtttcggtagagttcctttgtcccactgaagctgaagcagcgtgcttcccgaagcggcacacacatccggagcaagcttctctaaaagcgaataggcctcatcaagcgctgtcggcctccataattgaatattcatccttgcttttgtcacttggccgttcaagccatcgccctccttaccatgtcatattccttgggtgtatcaatatcgtccaactcaccgctatcctttgcctccaaaaccgctcctgctccaagctgtccgcttttcaggagcctgcgagccccttcatctccctttaacccctttacataaggaaaacaagccgacgagaagtagattggcggggtgaacgttcctaaaaacgatgacacggcaaatgactcaggagccagtgccataagggcattaagatgatcgacggaaagctgaggctggtcggctaacaaaatgacaacgccgtccgcccccatgctttctgcttttctcaccccgctgctgactgaatgcccctgacccttttctgcgtcttggcaaatgtgcaggctccagcgtttttgaaaaggcggagcgtgatacggcgtccctatccactcaagggaagcatgttctgtccgctcgacgaccagcacgtgatcaaggcgggacgacagagcagttttcaaagaaagtgagcctatgttttctccttttagcggcaaagccagcttgttttgacccattcttctgcttttgccggcagcgagaaacacgccgatcagataggggtttctcatacaaccgccagccgttttcttgtttgaataatttctgcaactacacttaccgcaatttcctcgggaccttccgcaccgattttcagcccgaccggactgtaaaagtgagacggaggatgttttccgttcagcagccgtttcgtgcggtttgccgaacccaacagtccaatataatggaggttttgagaaaataagaagttgatgatcgtttgatcgtgctgataatgatgcgttgccacaacagctgcatcatgcgaaaaaaattgaaattcgctaagcatttgttccggaaaagcggcgatcagctgatccgcttttggaaaaagagaggatgtacaataagcgggccgccaatccgtcacgataacagaaaaacctgtgtcagccgccaaattggccagcggtacagtatccggtcccgccccaaacagaatgagacgcggcttcggttcaattcgctgaataaacatgttagtggtttgatcgaaatgcggtaaatgaagcgttgaaacaatacgttgaatatcttgcagaggcgcgtccggccagttcccaaaatgcccgttctccgtcagaaataaataatggggggatccaatctttgtaacggcagtgacagctttgcctgaatgaaggcagtccctcactttctcatagtgccgccttttttcctgagtgattcgctccgcatgaacatgaataatgccattgcacccggctcccatgccccaagaaagatcatcctccgaccgcatgtcgtagggaatcagcgttgatgtgagctgttcgcccagcgcactgattctttggaatacatcttcttccacacacccgccgctcagcaagccaatccgtctgccttttttcttaaagagcatagaggcgcctgcttttcgatacgcggagccttcaacttgaacaattgtcgccagtacagcctcctcctggtcttccaggagcgcatctaacatcgtgtgaaaattccccaatgccgcatcctcctctcgaaaattgccgtgagaaacaactagttcagcgtgattttataggtaacttgtataaagaatagatgatggaagaaaaaatgactcatgatttgtcagaaaataaaacacatagaaagaggatttgtaaaaagagtcaaacgaagaaaatcagattggagaaaacacgaaatcatatcgttaaaaagcttgcggagttccgcaagcttttctttacaccgctgcctggcggtcagcgttttcatacacatccagcgctgcttggagcgcttttcctgcttcgattcctgcgttatgtctaagaagcacagcctctaacccggcaagcacgaatagcacgttttcttttctgcagctgtaccccatcgtgccgattctccagatcttccctgcgagcgggccgaatgagctggcgatttcaatgccgaattgtgccagcagcatgtcacggacagactcgccgtcaatgccgccgggaatttcgacacaggtaacaacaggcattttgcagctgtcatctccaaacaatcttagccccattgcctttatccctgctgctaatgcggcttcatggtgccgatgccgctcgaaacgcgtctcaagaccttcttcaagcaccagtctgactccctcacgtaaggcgtacagcatcgtcgtcgcttctgtatgatgattgagccgtctttcgctccaataatcctcaagctggctcaaatcaaagtagttgcttgtaattggccgatttcccgaaagtgctgccctgtcagcttgtgtcgcaatcccgcgttccacctttttgcgagctgcaatcacgtccgccacccgctcattatatgtaatcggcgccattcctgaaggcacagacaaacatttttgcgttccgccgatggcagcgtcaatcttccattcatcgactttaacctcgcagcccccaagcgttgcgactgcatcgacgataaacaatgcatcctcggtgcggcaggcttcgccgatggctttcagcgggtgaatccgtcctgtcgatgtttctccatgcaccatggccacaattttcggcttcactttttttatctcccgtatgatgtcctctgggtcaaaaaccgttccccattcgcactcaagcatatgaacatttgccccatatcgctcggcgatttcagtcagcaaataaccgaaacggccgtaaatgggaatgagcacatcatcttccggctctatcacactggccagcactgcttcaattcccgcccgtgaagtgccgtcaatcgggtatgcccagcggttttttgtttggaacagctcccgaagcatctccatcgtttcattcataatacctgtaaacgccggatcaaattggccgacaaccggggtgctcattactcttaatacacgcggatcaacctcaacaggccccggcgtcataatcgttcttaatggggtgcataattctcttctgcctgacacagccattcctcctttatcagtaagccagtttgtataataaatcagtcagtgcgcggacgccgatctcaagctgtctggctgacgtatattccttcggtgagtggctgatgccgcctcggcttggcacaaacagcatacaagcaggatagcgccttccgatcatttgcgcgtcatgccctgctccgctcaccatttcctcacagctgaagctgttttctaatgctgtttcaaaagccgcagccttcagcctttcgtccatcggcacaggctctatccgcatatattcatcaatcacggcgcgaattcctttttgaaggcaaatgccgttgatcaaagcaaccatgtcttgatgaaactgctccagcacatgctgatgctgatggcgaatatcgattgaaaactggacgcggcccggtatgacattggctacattgggctctgccgttatttttccgcatgtcagacggagctcctccggcagctcctccgaccgcagtagcagctcatgaatgatacggctgctggctgcgagcgggtccttgcgccatttcatggaggtagttcccgcgtgattgcattccccctccagcgtgacgagatatcgcctctgccccgcaatgcttgtcacaatcccgagatcccgtcctgacatttccaatgtctgtccctgttcaatatggagctcaacaaaagcgctgatatctgtccgatatgctgcctgaaacacacctttgccaaaaccgttctcatgcatcgcatgttgcagcgagactcctgattcgtctcttggctctgctccatcctgtaatgaaaaaacacccgttatattccctgatccccaataggtcattggaaaacggctgccctcctcctcacataaggataccgcttcgagtgtttttttcggcgctccatatgtctctttgagccgctttatcgcaagcattgccgccagaacaccataggcgccgtcgtattttcccccattgatgacagtatcgatatgtgaaccggttacaatgacttcatccggagactgggtgcccgaaagccttccaaacacattgccgacatcgtcgaatcttgtttcaagcccgaaagaagacatttccgttttcacagcaagctgtgcgtccatccactcttttgtgtataaaagcctcgttacgccgccatccgcagacgcaccgtattgggcgagccattcaatataatctgtgatgctgttttttactgaaagcttctgcttttccatgtactcccccctctggccgctatggtgacttcattatagaaggaggaacatgatagttcattgacagattaaccaaaaaaacgtttattttttagccacagtatctatccagcaaccagcttcaccctacatgtcacaactattttgatgtaaaggtcaaaagaaaacacggtaaggaagagagccagcaagagcgaaagagagggtcaaaatgcctttcatatgaacaagctaagcttgccggagaggcgatgtttgcggaacggatgaaaacggaaatgccggcagcccgcaaaaacaggacctaaagatatgggaacaggagatttccgcctcctccaaaggaactaatttacaattttaatgaaaaatatacaaaatgacacttctatcctttatttcaattttagataatagacatgatctgataaaaggagggcaagtgatgacaaaaaaagcatggtttctgccgctcgtctgtgtattactgatttccggatggcttgcgccggcagcttcagcaagcgcgcaaaccgcattaagccttaatgaccgattggcgtcttccccttcaggaacgggaagccttctctcattagccgcccccgctgcaccctatgctgacacagatacctattatgaaggggctgaaggtaaaacaggagactcgctaaaaagcaccctgcaccgtattatcagcggacacacgatgctgtcctacagcgaagtgtggaacgcgttgaaagaaacggatgaagatccgagaaatccgaataacgtcatcctgctctatacgaatgaatcgcggtccaaaaacctgaacggcggcaatgtcggcgattggaaccgcgagcatgtctgggcgaaatcccatggcgattttggtacgagcaagggacctggtactgatattcatcatttgcgcccggctgatgttcaagttaacagcgccagaggaaatatggattttgacaatggcggcactgaatatgcgaaggcacccggaaattattatgacggcgattcatgggagccccgcgatgatgtgaaaggcgatgttgcccgcatgctgttttacatggctgtccgttacgagggtgatgacggctatcctgatcttgagcttaatgataagacaggcaacggctcagctccttatcatggcaaacaatctgtcctgctcgaatggaataagcaggatccggttgacgaccgcgagcggaaaagaaatgaaatcatttatgaaaaatatcagcacaaccgcaatccatttatcgaccaccctgaatgggcggatgagatttggccgtaagaaaaaggtgctcctttttaggagcacctttttctaatacacagcctcttccgtttccgcatcgaaaaagacgacgtggtccattttcactgagagctggattaaatcgcctgcatcgattcgcgtgtttccgtccagacggaccttgagccgctcgtccccagccatgacatgcactatgagctccgagcccagattttcattcacttccacgttcgcttgaaacactgaatcaaacaactggtcatttcctgtcatttgtgtgatgtgctccggccgtacaccggcaatcatctgttctccggcatatcccttttccttcagccgctttgctttttcttcaggaatatgaagccggatcgaagaatttgtgaaaaacagctcgccatgctgctgttctatgatgcctttcaaaaagttcattccgggagagccaatgaagcctgcgacaaacaaattggccgggtaatgataaatgtcatgaggtttcgccacttgctggatttccccttcattcatgacgacaatccgatctcccattgtcattgcttcggtctggtcatgcgtgacataaatgatcgttgcctctaatcgctggtgcagcttgctgatttctgtccgcatcgtcactcttagttttgcatccagattagaaagcggctcgtccattaaaaagaccttcggctccctcacaatcgacctgccaagcgccaccctttgccgctgcccgccagagagcgccttcggttttctcttcagcaaatgttcaatttctaaaattctagctgccgcatgaacccgctcggcaatttcctgtttcgccatctttctgagctttaatccaaacgccatattatcaaaaaccgtcatatgcggataaagcgcatagttttggaataccatcgcaatatcacgttcttttggcggaagatcattgacccgctccccatcaataagaagatttccttcagaaatgctttctaatccagccaccatccgcagcgttgttgattttccgcatcctgacggccccaccagcaccaaaagctccttatcctttacatctaaatcaaagtccttcacggttaattgtgagtgatatgattttttgacgtgttcaaatgttaatgaagccatcagaaaagtccccctatcttttgacccgttatttcgtcactggaaacaacttggtctttctgttatttttagagtaatcgattcccatttttgctatatctctaaaataaaaaatgtaaatttgtattataacgtcataatacattataatataaataataggttaaaaggaggctaccctttgttaaacaacggaagttctacacctttatacattcagctaaaacaaatcatcactgatgacatcaaaaagggcgtgtattccccaactgccaagctgcctaccgaaaacgagctttgcagcaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatccaccggcaaaaaaccgaagcatcatgtgctgtcccatgacatcattccagcgacaaaacccatcgccgaaaagcttcaaatccatcccgagagccctgtcgttgaattaaaacggattttatataatgatgatcagcctctcacctttgaagtgacgcattatccgcttgatttgtttcccggcattgatacctttattgctgacggcgtatccatgcatgatattttgaaacagcaatacaaagttgtacccacgcacaatacgaagctattaaacgttgtatacgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataacaggcataaaaaacgagacactgcttatagtattctcgttttttcactgcttcccccgtcctccaagcgataaggatagccatagccgaaagctccgtacacaccgcatgttttcgcagccgtttcagcagcctggcgcaaagcgtacgttatatcctgcttcacgcaaaaggcagtcaaaaagcctgctataaaagaatcacccgctccaagtgtatctattatatcagtttccacaatcggctgatgatagattcgatcacccgcagacaggattgctccttggccccctcgggtcatacaaaccattttggctccgtacccatgagctgttttggcaagctcgccgcattccgactcactcaaatcgcttcctgaaaaaaatgcatacgtcacataaggacagaccctcctcaaataatcatcctcccgattggttgaaaaatcaaatgagaccgggacaagcccgcacagctggggaagatcgttctcaagcctgctgtacacgctcgtatgcagcagatcatgtcctctgataaaggctatatctttctcctggaacacgagccgaagccgggactgaatgccgcctttatttgacctgacaaaaatgcggtccccctgttcatcaagggtgacaatcgccatcccgttttctccgtgcgcctggcggatataatctgcattgacctgctccagcttgagaacgttcaacagatgtgccgcggcttcgtcattgccgacgattccgatataggaagactcatgcccgagccgcttggcaagcacagcaacgtttaaagcatttcctcccgggtaaaatgtttcttgatcctggtaataatctacaacattatctccaaccgcaatcaatttcatagcgcttcctcctttatccttttacactgccgcttgcaatcccgcggacaaaatatttctgcatcaataaaaatagaataataatcggcgcggctgaaatcgttaaccccgccagcaggacgccccagtctgtctgcagcgcgtctctgaactgcatcagcccggctggaatggtccgcaaattctcatcatctatgaaaataatcgcaaacataaactcattccatgtatgataagctgtcaaaatgccggatgtcaccaaaatcggcacgctcattggtaagaaaattctgaaaaatactccaaaacttgtacacccatccaaataggccgcctcctccaattctttggaaatagaaagaaaataagagcggatcaaaatgatggtgaatgggatccgataagccgcatacggcaggattaacgcccaatacgtattgtacaggccaagcgactgaataatagaataaagcggcacaagactgacctgcggcgtcagcatcaatccgccgagacatagcaccaagaagaatccttttcctttaaactcaaaccgggaaaggccataagctgcccatgcactgataaagacagtgatcacacacgtcagcgccgtaacgatgacactgttcataaaataagaagaaatcccctggttccaggcggaaacaaaattttccggatgccacgaagacggcagcgaccagctgtgctcaaaaatatcgtcagagtttttaaaggcgctcatcaccatccagagaagcggataggcaatcgcaatcagatatagaaacagaaaaacccacacagacgtttctccgatataccattttcgtctaggctttcttttcacctcaatgtgctggtcaggcacaggctccaacctgaacgaatctgtcttcttctgaggcagcatcagttactcctcctttccggttttaaagaacttcatttgcatgagcgataatgcaagcgtaatgattaacacgacagtggcaatcgctgaggcgtagcccatcatatcctttgtaaaggcgcttttatataaaaacgtgctcaagacttctgacgcgtttcccggcccgccgcctgtcaaaatgtacggctcattaaagaccgtaaaggccccggtcagcgtcatgaccaccgcaacaaaagacatctctttcgtctggggaacagtaatatgaaaaaactgctgaattttacccgcgccgtcaagccgggccgcttcatacagttcatccggtattttttgaatcgacacgatgtacagcatcgcaatataaccgacagattgccactgggacacaaaaatgacagaaagcatagctgtgctgtcatccccgagccaggccctcgtcagctgatcaagaccgatggcctgaagcagctgattcaaaagccctgtctccggattgtaaataaaatcaaacaaaagcgcgatcaccgtcattgagatgacaaccggcaaaaagaaaacggtacgaaaaaacggcgaccattttctgaccagcttatcctcaagcaccgccgccaaaatcaaaccgccaaacacctggcatacaattgagatcactgcgtaaagcacgttattggtcagtgcctgataaaagacaggatcatgaaataattcaacatagttttttaagccgataaacgttttttccggagaaaatgagctccactgaaacaggctgaggaatacattctcaaaaatcgggatataaacgaaaagtaaaaaaacgagagcgggcaccaaaaacaaataggggattattttattctgattgaccaagggtatctcatctcctttataaaaagaaaaggtgcgaagcttcaccttttctttgatttattcagctgacgccctcacctgctttgctgccttttgaacggctttcatcacctgctgcggtgtcatgtcgccgccaagcatttgctggacacccgttaggtacgcatctgcgacttcaacatcgacatccatatcaaaccatggaaccattgatttggcatcaacaatatgctgaacggcttcacgctgaatggctgttgcattttcttcagtagccgtaccttgcactgcactgtatttcccgacatctttcacgagcttttcgcccatttttttcgacgtcaagaactgcaaaaattccatcgcttccttcggatgttttgttcttgaggaaatcatgaatccttccggcgctcccgttaacgcttctgaagatcctttctgcccgctgatttcaggaaatgggaacatcccaagattaaccggttcaaccagcttgatttccgctgtttccgcatatatcatcgccgactttccgctcttaaattgctgtctcacatattcgtggtcgacggagtttacatgtttattaaagtaaggcatcagctcttgaagcttttcaagtgcttttacgtagccttcatcagtaaattcacccgttttggcgttatagtccttttcccgtgttttttcatcgaccatccgctgattaagcgtgccgatatagtgcgagattgtccaagtcgcctttgttccgaagctgatcggtgtgtagccatgttctttcagcttttttgacacatcgattaattcatcccacgtcttcggggatcaagattcagcttttggaaaatgtctttattatagaagaatgatttagcgtccatttgccacggcacgccatattgcttgttttcataagtaaatggtgtaatttgcgattgaacgagctgtgatgaccaatcggtgtcatttttgtagtaggacgagagatcaagtgctttattgcctctgataaatttaaaagcaaactcatcgctccaagagaagtaaatgtcaggagggctggtggttcccagcatgaccttaattttatctttataggagtcatttaaaacggcttcaatttgaatatcgatatctgggtgttctttttcaaattccttaacaacctcttcaaaataacttttttccggctccttcggccatctgtggaaaaatttcaatgtcacctttccgtccgctgaactgctttggctcgaacagcctgcaatggtgaacatactgacagctgcaatgatcaagaacaacaacattttcttcaaagggttggcctcctctggacattagactataatgttatataacattatagtctaatgcataatggttcctcattttcagatcaatactcaactttccacatgtatcttctatgagataaaggatgatttctcgcctctgccagctcgtctgcatagcttctcagcacacgattgagaacgagcggagcaaggtagcctttaactgaatcgtcaattgcagtgaagtcgtaagatgcagcatcaagcacagtgagctttttgccatactttttcgagaaggtaagcgcccgctcttcaagaggtcttgtttcatctaaaccgagcaggatgataaacggcacggattcatcaataatttcaaacggtccgtgaaaatattctccggcatgaatggcgtgggaatgaatccattgcatttccatgagaatgcagatgctgtaggagtaagcgacaccgtagtttgcaccgcttgccatggtataaataatactttctttttcatgggcttttgcaaattgcttggcgttgtcagcttcctgcttaagggctttttcatatacagcctgcaattgatctaagccttcaattgcttgttggaatttcgtattgttttctaatacttgcagggttccaaaaacgatttgatacaaaacgccatagtttgtattgatcgcaagcgcctcatcaccccaatcgtactgggcaacatattgcgcttcctgcgctaaaggagactccggtttaaacgtcatcgcaatcgtaagtgcacccttgccccttgcaaacgcagcagctttgactgtctccggggtatttcccgaatgcgagcacaaaataacaagagacttttcaccaagctgaacagggttgcgctgaataaattcgttggcgctgtagaggtcggagtttattgattttgactctctgtcaaacacatacttactcggatacataattgcagaagaccctccgcatgcgacaaagaatacatgatcaatggttttccctttcaaatcctgcaagaaagcttgaacctcacgatttacttttgctgtggcctgactcaaatccttcactccccgtttttattatataacgttatataacattatatattgttatattaaagtccgcggctaggattgtcaatattattttctgaaatttctcaataatttattcgaatgatagacaaagggcctatatgcgtaaaaatgcccaaatcaaaagccagaacttgacttaagctctggctcgctgttcaatccgcagactgacgtcttatttaaaaaataccttgtctatgttgtacttcgagtgctgtgtattgatgatatatgtttcgtaaatctctctttccattggatcatcaactacacatacctcaattttatatacttcgtctctgtgatgtttgatcggtgaaacagtgtcttcgaaatgcttcttaattctctgtcttaactttctggctttaccgacaaacagcagctcgtcatgaatgttgtaaaacataaaaatgccgcctttgtcccttgggatctggtgaaagtcgatgaatccgtgaatcggttttatcttcggttcgttatcattagctgactgctgtcgttcagtgatggtgacattcggtgcgggtatatcaatttttatcaaaatcagttcacgtcctctttttcattaaagataaatgctaacacatacagaaaagaaaagccagaacagctttatactatttgtttgttaagcctttatttattatgcaagcgctccggctggatcatacgggccaaggtcgatttcagtctgctttccgagaacgagttttgcgagctctgcacccaagaacggccccatcgtcagtccagaagcacccaaaccgtttgcagcatacaggccttgaacattcggcacggcccctacgaccggcagaaatcccggtgtaaacggcctgaagcccactcttgtttcaacagcagccgcatcagcaagacccggtgcaacggctaacgctttgctcaatacttcgtgctggcctccggctgtcacacgcagatcatcaagaccggcatcgttttcgtgtgtggcgccggctacaattctgccgttatcaaacgacagaatgtactgatcactcggcggcattacaaccggccacgatcctgtatctgcatctgtcatttcaaaatgcataatctgcgctttttgaaatgacacttgaaaatgaatgccgagaggcttcaatatctcattggcccatgctcccgccgtcacaatgaccgcgtcagccgcaatctgctttatatctgtttgcacgccggtgactgttccgttttcaaaaagcaaagatgcatttcctttgatgaccgttgcgccgcgtttctctgcagcgcttaaaagcgaccggcacagcgctcttccgttcacacgggcggcaccgctgatatgaactgattcatagtcatcagctaaaatcggaaacagctttttcgtttcacttgcggacaagcgggtaatgtcgccgatctccggcgcatcctcccgtctcttatacgcccgctcctccatcttatcaagctttgacgcatcagtatgaatgctgatcgcaccaacacgtttatatcctgtatccgtttctccgtcctcttccaactgattgattaaatccgcatagtatcgcgccccgcccttagcaagctgataccaatcctgattgcggcgctgagagagccaaggacagacgatccccgccgccgcatcagtcgcttgtcccggctctttccgatcaatgacagtaacgcgagcgcctgattttgcgagatgataagccgtcgacgcgcccagaatccctgcgccgacgatgatgtacgaattcatatgcaaacaccttttctattataatgtctattcattttaccaaatagaatgctttccttcgaccttttgccctaatgtggaaaaaccgcgaagttcgtccaatctctttactctcctaacgaatatcctgtcactatcaatagagaaaggatgataccatgagcgaaaatcgtcatgaaaatgaagaaaacagacgcgatgcggcagtcgcaaaagtccaaaacagcggtaatgcaaaagtcgtggtcaacgtgaatacagatcaggatcaggcacaggcgcagtcacaagacggagaagactaatgaacgaaaacatcattcctctcaacagacatactcaagagatacccactactgaatctgttatcaaaaacagcggcaactcagaggtccatatcgacattcacattgatacaatgccaattgcttttgctatattatgctctgcattagccgcaaagcagatgacaaaagaggaattcgatatggcttatactcaattgcgagagatgaacagagaaaataacagcagatcatctgtaaagcaaattatcaaccaggagacagaagaagagtaaaaaaccgcgggccctgtggccagcggtttttcttctgcatacaaaaaggacgcgactgaatcggttacttctgtacaatttgaataaggttaccgcttgtatcgtcgaaaacagcaattgtgacttcgcccatttttgtcggttccatcgtaaacgtcacgcctttttcctttaatcggttgtactctttttgaatatctgcaacgccaaacattgtggccgggaagccttcggagaatatcttcttttgatactccttggcggcaggatgttcattcggttcgagtaaaagctcggttccgtcttgatcatctggagaaacaagcgttatccacctgaatttccccatgggaacatcctccttttttacaaaccccagtttttctgtatagaacttcagtgccttgtcttgatcttgcacgaatatactagtcacaatgattttcatattgttgtttcctcctttgatatttatggtgtatggtactgtgcaaacaatccggcttcaagcaaaacaaaccaacatttgtaagaaactcagtactggttttataaaattactctatccatcctttcagcaaatttttaagcggttcgttgttgaatataagtactcgatattttccctttcgttttgatgttacgagtcctgcatcctccagtacagaaaggtgtttagctatcgcctgtcgcgtaatagaaaggtcgtactttgtaataagacgtatcgtaagttcatacaacgtcagctcgttgcgttcagataattcgtctaatataagccgccgagtcgaatcgccgagtgctttgaatatagcgtctttgttccaattcatatattgagtataagcaactcattagttgcatgtcaagtataagcaactgtatggttgcgtgatatagaaactgaacctatccggcgcaggtctgaaatattctaatcgataaggaattaaaaccattaaaataacagtggatatgtctctgaaaaataaaagaagacgaacttcaaaagttcgtcttctacaatcaaattcggcacgccggccattttaaaaactatctctaaaccccttgataaacaaaggagttttcatcattaaccaatagaaccttccatttcgaacttaatcaaacggttcatttcaactgcgtattccattggaagctcttttgtgaatggctcgataaagcccattacgatcatttcagttgcttcttcttcagaaataccgcggctcatcaagtagaagagctgctcttcagatactttagacactttcgcttcgtgctccaatgaaatgttatcatttaagatttcattgtaaggaattgtgtctgaagttgatttgttatccataatgagcgtatcgcactcgatgttagagcgggcgccttccgctttgcgtccgaagtggacgattccgcggtacgttacttttccgccctgttttgaaatcgattttgatacgattgtagatgatgtgtttggtgctaggtgaatcattttcgcacctgcatcctgatgctggcctttacccgcaagagcgatagaaagcgtcataccgcgcgcgccttcgccttttaggatacaagccggatatttcattgtcagcttagaaccgatgttgccgtcgatccattccattgttgcgttttcttcacagactgtacgctttgttacaaggttgtaaacgttgttcgcccagttttggatcgttgtataacggcagtagccgccttttttcacgatgatctcaacgaccgcactgtgaagtgagtttgttgtgtaaacaggcgccgtacagccttcaacataatgaacacttgcttcttcatcaacaatgatcagtgtacgttcgaactgacccatgttctcagagttgatacggaagtaagcttgtagcggtgtttcaaccttcacgcctttaggcacgtagatgaaagatccgcccgaccaaacagctgagttaagcgccgcaaacttgttatcagtcggtgggattacttttgcccagtgctcacggaaaatatcttcattctctttcagcgcgctgtcagtgtctttaaagacgatgccttgcgcttcaagatcttctttcatgttgtggtatacaacctcagattcgtactgagcagaaacacccgcaaggtatttttgttcagcttcaggaataccgagcttgtcgaatgtttgcttaatttcttcaggaacttcatcccaagaacgctctgaacgctcagacggttttacgtagtacgtaatttcgtcaaagttcagtgagtttaaatctccgccccattgaggcatcggcatgttgtagaaatgctcaagtgatttcaagcggaagtcaagcatccattgaggctcttctttcatgcgagaaatttcttctacgatttcttttgtcaatccgcgctctgaacggaaaatggaaacgtccttgtcgtgaaaaccatacttgtattcaccaatatcaggcatttttttagccatccattttcactccaatccttttaattgccgccttcttctttcgcgactcctttttcaagtgctttccatgagagggttgcacatttgatacgggccgggaattttgaaacgccttgaagggcttcaatatcccgagatctatagaatcatcatactctttcccttgcatcatatccgagaaaatcttagacatggaaagggcagtttcaatatctttccctttaatcgcctgagtcatcatcgaagcggatgccattgaaatggaacagccttccccttcaaatttcgcatcttccacgatgtctccgtcaagcttcattgtcagtctgatgcggtcgccgcatgtcggattgttcatatccacgacgatgctgtcattcaaaacccctttatttcgcgggtttttgtaatgatccataatcacctgtctgtacaatgtatctaagtttgcattaaaagacatttgtaaaatactcctttgtcttttgaagagcttccacaagcttatcaatctcttcctctgtattatacagataaaagcttgctcttgcagtagcagttacatccagccatttcatcagcggctgcgcacaatggtggccggctctgactgcgattccctccgcatcaagcacagtcgccacatcgtgcggatgaacatcatcaaggttaaatgtgacaagcccggcacgctcttccggcccgtaaaccgttacgccgtcaagctggcggaagcgttcaagcgcataagctgcaagcttgtgctcatggcgggaaatctcatcaagaccgatttcttcgagaaaatcaatggcggcacctagaccgattgctcctgcaataatcggcgtacccgcttcgaatttccacggaagctctttccaagttgattcataaagcccgacaaagtcgatcatttcaccgccgaattcggcaggctccatgttttccagcagggctttctttccgtacagcacaccaacaccagtaggtccgcacattttatgggaagaaagcgcaaagaagtcgcaatctagatcctgcacgtcaattttcatgtgaggcgtgctttgtgcaccgtccaccacaattacagccccattgtcatgagcgattttcgccatttctttaatcgggttgaccgtgccgagaacattagatacatgagacaccgcaacaatttttgtgttgcttgtgaccgtttctctgacgtcttctaaagaaatcgttccgtcttcctgcagcggaatatattttaatgtggcgccagttgcttttacagcctgctgccacggaatgatattcgcatgatgctccatgtaggtgatgaccacttcatcaccaggtttcaggttggcgcgcgcatagcttaacgccaccatattcagtgatgtggtcgtgccttttgtgaaaataatctcagccattgacttcgcgttaataaacttgcggactttttcacgcgctccttcataaccatctgtcgctctggttccaagtgtatggacgccccggtgaacattggaattgtattggttataatacttatccagtgtttcaatgacagcacgcggcttctgggaagtcgccgcgctgtcgagataaacgagatcatgtccgttcacttgctgatgaaggatcgggaactgttcacgaatatctgtgatattcattacttcactttcctttcgataacagaaactaattgtttcttaacgccttcaatcggaagttcatttactaccggtgcaaggaatccgtaaatgactaagcgttctgcttcttctttcggaattccgcggctcatcaggtagtaaagctgaatagggtccacacggccgacagatgccgcatgtcctgcagttacatcgtcttcgtcaattaaaagaatagggtttgcgtctccgcgtgctttttcgctgagcatcagcacgcgtgattcttgctccgcattcgctttagaagcgccatgttcgattttgccgattccgttaaagatagaagaagcggaatccttcatcacaccgtgcttcaagatatagccttcagaagctttaccgaaatggatgatttgtgttgtgaagttttctgtttgctctcctcttccgacaacaaccgttttcgtatcgccgtatgtgccgtcaccgtaaaggtttgttgtgttttcggaaatcgtgtcgccatcgttcatcaggccaagagcccactcgattttgctgtcgcgtccgcgcgcagcaccgcggcggttcacataagttgtcacaccgcttgacagattatccaccgcaccgtatgttacgctggcattatcacctgtgatgacctcactgataatattgaagacagcgtctttcggatttacagtgctgatgtagttttctacatatgttacagagctgtggtcttcagccacaatcagcacgtggttgaatagagctgtatcattgctttcgtggacataaacagcctgaaccggcgtctccacctgaacatttttcggaacataaaggaatgctcctccgttaacaagagccgcgtgaagtgcagttaacttatgttcgtcaaccttcacgccgtccttcataaagtatttctccaccaagtcgctatgctcacgtgcagcagtcagaatatcagtgaagatgacgcctttgtctttcaattcttgagaaagagaaagatgtgccggcgtctggtcacgctgtacgtataatgttttatcttcgttttcaacgtcgatcagcgcttttacttcatcagtcaaatcttctaatgaagaaagcggttcgttatccactgtatgcttcgcgaaattcgtgaagttccagtttgtgatttttgttttgtcaggtttcggcatcggcagatcctcagcttgttcaagagcctgtaagcgcaggttcttcagccaggcaggttcttggtgcttttcggaaaagcttttgagatactcctgatctacggatagttttgtacctagtgtcatattaatccccctaacgcttacgcttcttggccaacagtttcgtcttcaatgccaagttcttgtttgatccagtcataaccttctgcttcaagacgctgtgcaagctctgcaccgccggattttacaacgcggccttgcatcataacgtgaacaacatccggagtgatgtagtttaacaggcgctgatagtgagtgatcatcaagcagccgaagttttcgctgcgcattttgttgatcccttttgatacaactttcaaagcgtcaatatcaagacctgagtcaatttcatcaaggatggcgattttcggttcaatcatcattaattgaaggatttcgttgcgttttttctccccgcctgagaagccttcgttaagatagcgctgagccatttcagggtccatttcaaggaactccatgttttcgtccattttgcggatgaatttcatgagagaaatttcatcgccttcttctctgcgcgcgttgattgctgagcgaaggaagtcggcatttgtcacaccgctgatttcacttgggtactgcatcgcaaggaataagcctgcctgcgcacgctcgtccacttccatctccagtacatctttgccgtcaagcgtgatgctgccttttgttacttcatatttaggatgccccataatagcagctgataaagtggatttaccagttccgttcgggcccattactgcgtggaattctccaccttttatttcaaggtttacaccctttaagatctctttcccttcgatttcaacgtgaagatctttgatcgttaatgttgaagcagccatatctatacctccaaaaatatataatcattattctcattttattctcattctaattttataacaaatgaaaagtaaatacaactttttatcgtgccttgcacattcctcaagtttaacaaagatcagcactttattaaagcgattgaaaaagaaaaagagtggattcccacccttttttaaaagattgattttctcaataagctcccgcagaaatccgcttgcttttttcataatcaagctctctctgccgctctactttcattcttgtttccagccggcgtccatattcctcgtatccaattccgtgtgacagctgcatcgctttttccatttctgacgtataatcgaggttcagtctgtcctggctgctgcaaataatgaatcaatcccttcatatatttgctttttattgtaccagtgctgcgttggatgccgcaaaaacgatttggcgtgaaatagcggcagatgagacgaaagcatcctttcagaacaaatgagaatggtttttcggaatattccttctcttaatgcgtggtgtttccgaattcctcaatgcactgttgaacgactgtcacgccttggctgaaagccgcgccgcctccaaatgccgctgccacactgacggcttcgagaatgttttcttctgtcgctccctgatcgagacagccttttgtatgatagatcatgcaatattcgtcctgagcattgatggcaattccgagggcgatcagctgtttttctctttcagtcagagaattcccggcaaagcactgttcagtaaattcgttaaattttcttcccatcagcggcatcttttgttcaaatgtgcctaaaccatgtttatattgttttaacgcgtcctgcatgcttcctctgtcttgattcaaagaaaatccctccatctgtttaacattcctttttattatgaacagcttttaggaaaatacgcgaaaaaaacccggatttctcatccggggtttcagtcttattcagatacaggaagcacagctccgtcgtattttttctcgatgaagtctttgatctttttagaatgaagaacttccatcagcgctttgattttggcagaatcttcttcgccttttcttactgcgataatgttagcgtatgggttgtttttcgttgattctacttcaattgcatcttttttaggatttaatttattttggatcgcatagtttacattgatgaaggccgcgtctccttctttgttttcatatgcttttgccgttaattcaggcgctacttttttgaattcaaggtttttcgggtttttcttaatgtctttcaatgttgcgtcaactgtttctaccttagaatcaagagtgattaatccagcgttttcaagcattgcaagcatacggccttgttcagcaacgttgtttgtcagaatgattgtcgcaccgtctggaaggtctttcagtgatttgtatgttttagagtaaataccgaatggctctaagtgaacagcaccggcattcacaagtttgtaatctgtgttttctttcatttcttgctcaaggtaaggaatgtgctggaagtagttcgcgtccacttctttatcagctaaagctttattgtacattttgtaatcactaagcactttcactttcagcgtataacctttttctttcagcaatggttcagcttcttttaaaatttccgcatgcggtgttttcgttgccgcaacgacaatttctttcttgccggattcagcgccgttattcgaaccgcaggcagccataactcctgcaaatacaagcagtaatgcacccaaaaatagctttttcaatgtaaatcctcccttatcgtttgtctataatatttgttattagatcaccgatgatttgaataataaacacgatgattaaaataaacacagtagcaacgaaggtaacatcagcgttattagactgatatccttctacgtacgcaaggtttccaaggcctcctgaaccaatggctccggcaattgccgttgagccgatcaaagcgatggctgtaaccgtaatgccagaaataagagcaggcattgattccggaatcagcactttgaaaataatcgtagacgttttcgcgcccattgatttagctgcttcaatcacacctttatccacctcacgcagcgcgatttcaacaaggcgcgcgtaaaatggtgccgagccgattaccagcgccggcaatgcggcgtttggccctaagatcgtgccgactaaaaatttcgtaaaacctaatagtaaaataattaaaataaggaacggaatcgatctgaatatgttaacaacggccgcaatcactgagttgaccgctttattctgccagaggcttcctttgctcgtcagaaagagcagcaagccgaggatgaccccgatgacaaaagcaaacagtaaagaaatcagcgtcatataaagtgtttcatatgtcgcgttccataattcagttaaatcaacgttcgggaagtatttttcaaacattcgtgatcacctctgctttcacctgtttgtcattaatgaatcggatcacgttttgcacttcttcctcgtctccgtcaatgtggatgaacagtgaaccgtaagccccatccttcgtctgcgaaattttcccttgcagaatattgacgctgacattgaagtttctgatcatctctgtaatcagaggctgttcagctgactcaccgacaaatgtgagctgaaccatttttcctgatgctgtatcatcaagaaggtgttgaagcgtctctttcgtttcttccggctctgtcacctgttgaacaaatcgttttgtcatttgttcctttggatttttaaagacatcgagaacctcgccttcttcgaccaccttgccgttttccatgacggcgactctgttgcagattttgcggatgacatgcatttcgtgcgtaatcagcacaatcgtcaaaccgagtctttcattaatatcggacaatagatccagaattgaatctgtcgtttgcggatctaatgctgatgtcgcttcgtcacaaaggagaaccttcggattgtttgcaagcgctctggcaattccgacacgctgcttctgcccgccgctcagctgggacggatatgatttttcttttccttctaaacctaccagtttaatcagttcattggcgcgcttgatccgctcgctctttttcaccccggcaatttctaaaggaaacatgatattatctctgacagtccgcgaccaaagcaaattgaaatgctggaaaatcatactgatctcatggcgtgcttttcttaaaccgcgtccatttacttcattaatcttggttcccgccacttccacggttcctgaggttggtttctcaaggccgttcagcagacggattaaggaactcttaccagctccgctatatcctataattccaaaaatctcaccttttttaatggaaagcgagacgttttggacagcattgacatctccatgtttcgacttgtaaacttttgaaacatcctgaagattgatcaaagcaatcacctgccttaacactattctaagaaatcttccggttttttctgcaaaagaaaagcctttctgcacacttgagcagaaaggcttatataaaatgcctttctctcatctttcaaagctgaacgcttcgtgtgaattggcaccatttcaacagtgttgatggttgccgggcttcatagggcacttccctccacctctcttgataagagaaatatatagtctttttcgtccggaaattcttaatgtagaatagcacggcgaatgattaaatgtcaataaaataaatgatgtcaacttttactattataataatttattattttttaattttttataatcctctgaaaaaatccatttgtcagccagagaatggcttccagttttaacagggccctgaatgacccctttactttgaggcttccgctctgaatcaggtgctgaagggaaatgtctccgtgcaataaatcaataatttccgtttggtttccgtaaaaggtcaggttggacgtttggggcggagaaacttttttcatttctccctgttcgtttattgagacggttaaggcttctgcttctccttggaaggtaatgagcaatgttgaggctttcaaaaggggttttaaaaacagatgctgatactcatcttctaaaacttccgctttctccatatgtacaacctcctatttgttggtcatacatacacatttctctctttgtcgcaagaacccctttataaaacgaacgacaatttcattggatatgctgagaaatatgtcataaatgggatgcggaagatgatttttgtttgatcagctcatataaataagaaacggaatgaaatgcatatcctctttcgaccacctttccgcctttaaacagcagaaaacaagggacgctttcaatttgatacgcttttgcgaatgtcggagagtaattgacattgttttgatagaaggcgacatccggcagcatttctttcaccactgtcagcattttgcttgcaagctggcaggtgccgcaaaacggagtatataaatatagaaggtacacatcatcttcaatgtgatcaagttcgtgttcttggagttctttcatgctatacacctcgggactttctttcaagaaaaatagtatggacattcagattcgcacgcagcaatacagaagcgatatggtgcctgggcgcagccgctacttccttataggctctgtcgatatggagatggcaggcttcattaaattcacgcttcagctgttttctcaatttctcacctgattcatcagcatcaactaatatatagacgtctttatcataaagctcgtcagccaattcctcgagcctcagctggctgattgttccgtttgtgcagataatgcgcaccggttcattcaggacgctttcgattttctctttatctgatttcccctcgacaatcataaccttttccagctcatccatcttcatcttgttcacctgccgcgtcaaatttgaaacgttcagattgtaaaagaaggcagtgaaattcaccgccaacattaacaccagccgttttcgtagtcacaatctacatattttgcgtcgtctccagagaccacatcggctgtcttataaaatttctcattttcaaaggaataaccggacttaagctcatattcattcatgcttgtcatttggccgatcatctcattatcatgatataacgagagccggccattttgaaagcggcctgtcacgtcattggtgacatcgagcttttgtttgtcgaaagccatattggacacctcccataacgttagcgtgtccaattgcttttacggctatcctgttttagtcttcttgtgtcatctcttcatattgctctgctgtcatcagtttttcaatttcagaagcgtcggatggctcaacgacgatcatccatgctttttcgtacggagattcgttgacgaattccggactgtcatcaagatcttcgtttacttccacaaccgttccgttaatcggtgcataaagctcagataccgttttaacggattcaacactgccgaatggctcgtccgctttgatttcagcgcccacttcaggaagttcgacaaacacgatgtcgcctagttcggactgggcaaaatgcgtaattccgattctggctttttctccttcaacttttacccactcgtgttctcctgagtaacgcaaatcttttggtatgctcaattgaatccctccattttttacagcactacaataagaagataccacacttttcaaaaaaaatttacattaagcccagttttcttcaaattggtcttctttaaatccgacagtcactttttcgccgtctgttgtaagcgggcgtttgatcagcatgccatctgaagccagcagctcgagctgttcgtcctctgacatgtgatacagcttttccttgagattgagctcgcggtatttcatgccgctcgtgttgaaaaatttcttgagatccagcccgcttttttcataaagcgcttttaattcttctttgcttggcggctgctcagcaatatgtatttcgtttatttctttcccatgctcttcaagccacttctttgctttgcggcacgttccgcatttagggtaccagtaaaaagttaacgacatcttcttccccctcaataaaataatcgaggttattttaacacagtttgttttaaaaacctaaaacagtgcttcttaaaaaagagctccgcgcattcggagctcttggccaatcagacagtatatttctcagcctcaaaaatgcctgccgccgcctcgcgttttttctgaatcacgtttttaggcgttacgcgtgtcagcttgcgcagagcggaaaacatcatgcggagtgaatctccttcttccattgcgataagggattccttcgcatgcgcttcaatttcgttaaaggcctcttgaacgaaaatttctgtgtacagcaccttttgcgctgctttttcagcgccttgagcggcaatggccttttccgttctgagcacggctgattccattgcgtatacattgctgacgatatccgctacgttcacgagaatttcttgctcacgatcgatggcttttccgtatttttgcgcggctaggccggcagcaaacaacgcaatttttttggcttgcttgacgatatatttctcctgctctaagacgccgcttccaggctcttcaggcataagcatcatgagttcttcctgcagcgactgcgctttttcgaataaaggcagctcgcctttaagcgctttttttaggaaggtgcttggcacgattaaccggttgatttcgtttgtgccttcaaaaatccgattgatccttgaatccctataggccctttctacttcgtactcctgcataaagccgtagcctccatgaatctgcacgccttcatcaacgatataatcaagcgtttcagagccgaataccttattcagagagcattcgatggcgtattccgcaatcgatttggcgatttgccggccgtccttgagatcttcggccgtgaactggctcatattgtcttcaaacagtccgacggttctgtatacagagctttccatcgcatacagccttgaggccattgtcccgattttttcctgtgtcaatgaaaaaccagcaatcggcgttttaaattggcggcgctgatttgcgtatgccgcagacagctcgatgacgcgtttagatgcgccgattgtgccaaccgccagtttgtaacggccgatgtttaaaatattaaaggcgatgacatgccctttgccgatttctccgagcaggttttcctttggcacttcagcttgatccagaatgagggttcttgtcgatgatcccttgattcccattttcttttcttccggtcccgtggagacacccgggaactctttttctacaataaaggctgaaaacttgtcgccgtctaccttagcgtaaaccacaaatacatcggcaaaagcagagttggtaatccactgtttttcccctgttaatacataatgcgttcctgcttcattcagcacagctgttgtttttgctccaagtgcatcagatccagagccaggctcagtcagagcataagcggcgatcttttcgcctgaagcgagtcccggcaaatattttttcttttgttcttctgatccgaaaaagacgatcggcaaggaaccgataccgacatgcgccccataagaaagagaaaagcttcccgcacgcgaaaatttctcagtgatgagtgccgagctgattttatcaaggccgagccctccgtattcttccggcacatcggcgccaagcagccctagttcgcccgctttcttcaacagtctgacagaatgctcaaattgatggttttcgatatcatctatatgagggagaacatcttgctcgatgtaatcctctgttgttttcgcaatcattttatgctcgtcagtgaaatcctccggtgtatacatttgatcgtatgtgacatcctcgattaaaaatccgccgcctttttgtacttcagccgctttttttgccatttgtttttccccctttagcataattcaaatacaccggccgctcccatcccgccgccgatacacatggtcacgactccaaattgctcgtttctccgtttcatttcatggatgagtgagagtgtaagctttgtgcctgtacagccaagcgggtgtccaagcgcgattgcgcccccgttgacattcactttttcttcatcaattcccaattccctgattacttgaatggcctgtgaggcaaaagcttcattcagttcaaacaagccgatgtcctgcagctgaagtccggcaagcttcaaagcgcgcggaatcgcttccaccggtccgattcccatcacttccggcggcacgccgcctaccgcaaaggagcggaatttcacaagcgccgccaggccaagagcatcagctttttcccggtccatcagcatgacagccgccgctccgtcactcgtttgcgaggaattgcccgcagtcaccgtcccgtcaacggaaaaggccgggcgcaatgtcgataagatgtctgcagtcgtttgcgggcgaacaccttcatcctgagaaaatacaaattgtttttcctgaggcttatggttttctccaatttctgtcaccgtcacttctacgggtacaatttcatctttaaattttccttctgcaagggctttagcggcgttttggtggctgcgaacggcaaacgcgtcttgatcctcacgggagacgccgtattttttcgcgacttgctcggctgtgtgccccatactcatataatattccggtgccttttctgccaaagcaaggttcggacgggtaacatgccccatcatcggaacttgcgacatggattctgctccgccggcgatcgctgtatcgtaggcgccgagcataattttttctgctgcatatgcaatagactgaaggcctgaagagcaataacggttaactgtaatcgccggaactgtgtacggcaggcccgcgagcgcaccgatatttctcgccatattaagcccctgctccgcttcaggcgttgcacagccaataatcaaatcgtcaatattgccttcgtagccgcctgcccgtttcagcgtctcttttacacaaatcgctcccaaatcatccgggcgaacgctggccaaagatcctttttttgcttttccaaccggtgttcttgcacctgacacaatgactgcctctttcataagctccctcctaattccgtaaaggtttacctttcacaagcatatgctgcattctcgcttgagattttgcctctcctgccaaactcaaaaacgcttctctttcgatctccaataaatactcttcatcaacctctgtaccaaacggcacttttccgcccgcaatgacataagcgagttttttcgcgatcttgaaatcatgctcagatatatagccggacagcttcatctgctcagcgccaagcaagagtgccgcataaccggtttctcccggcaccttgaccttttcttttacaggcggccgccagccggtatcgtataaagatgcggccagctgcttcgcatcgtataacaggtggtcttgattcacgctgatctgatccgtttcttttaagatgttcatctcacgagcttcttgagcggaagcggacactttcgccatcgcaatcgtttcaaatgttttcattgccgcattcatcggatcaatgccgcggcgaagatggttgatgtacagctctttgttacctcctccgccagggatgaggccgacaccggattccacaagtcccatataggcttcgcttgccgcttgaatgcgcgccgcaggcaggcacacttccgttcctccgccgagcgtcatgccaaatggcgcggcgacgaccggtttcgcactgtatttgattttcatcatcgtctcctgaaaacggcgtatcacaaaatcaacttccaaaaagttgtcgtcttggacttccattaagatcatggcgaggttcgcgccgacgcagaaatttttcccttgattgccgatgacaaggcccttgtaattccgctctgtttcctctaaccctttgtggatcatctgaatgatatcgagaccaatcgcattgcttttcgaatgaaattcaagaagagccacatcatctccaaggtcaattaagcttgctccgctgtttttcgcaatcacgccttttgtttctttaagtgcatgtaaatgaattcgttttttgttttctttcacggctctgtattcgccgcggtcataataaaataccgttccgttctctttgatgtagaaggtttcatttcctttatccagcatctcttttatccagccaggcatatctgctccaagctgctcaagcttttccgctgactgcttgaggccgatggcatcccacatttcaaaagggcccagttcccagccgaatccccacttcatggcttggtcaatcgcatgaatatcatcggcaatctcgccaagcagctcggctgagtaaagcagggtttgagatgtgatattccacagcaatcggccggctctgtcatccgaataaataagcgctttcattttggcttttgtcccttttgcctgttttgccgcttcaagtgccggtgttttcatttttgtccgctcgccgtaagtaagcgtcactgggtcaagctcataaatcgtttttccttcttttttataaaagccttggccggccttacttccgatccaccctttttccagcatatcgttcatgaagcttggaaggcgaaacacttctttttcatcgccatcagctttgtcatacacatttcgggcaacgtgggcgaatgtatcgagaccgaccacatcaagcgttctaaaggtagcgcttttcggcctgccgatcagcggtcctgtgatcgaatcaacctccccgacctgatagccgcctttcagcatttcttggactgtcacgagaagcccgtacgtcccgatgcggtttgcgataaagttcggtgtgtcctttgctgtaacaacacctttcccgaggacattttctccgaaagctgtcataaactttaaaatatcaggatccgtttccttaatcggaatgatctccagcagctttaaatagcgtgcgggattaaaaaaatgcgttccgagaaaatgggctttaaaatcatccgacctgccttcagccatttcctgcactgatatgccggatgtgttgcttgagacgatgcttccagtctttcgatgttcatccacaagagcgaaaattttctttttgacttcaaggttttcgacaacgacctcaataatccaatctgcttctttcagtttttctgcatcatcctccagattgcccggtgtaatataggaggtatttttcgctgatgtgaggggagcgggcttttgtttcagcagttttttcaccgcctgccggctcagcctgctgcgcatctccggactgtccttcgtcagcccctttttttcctcttcctttgtcaaatcgttcggcacaatatctagcagcaggacaggaattccgatgttagccaaatgcgccgcaatcccggaacccattacccccgatcctaaaacggctgccttccgaatgtgtttgtgcatgagatatcccccttgaacattgaatgaataatcattcattttttgaccaaaaaaaatgaaactcgtttcttctttcatcttaaaagatttccggttcgacttcaatagctaatttgttatttttttgtatgaagcctataaaagtcgggcaacttaagcccggaggtgaagggaatggtacgagagaaaaaaaatccgtcttcagcggcagtcagcgcggcgagcgtaaagggagatgccggtccgactcagcattacggcggcggaaaacggacaagtcaaaatcagcagtataaaaaacataacatggaacaatcataatgcagctgcttcccgcggctgctttcactttttcaaaattccttttaacacaaacgctgcattggcaggccgttcggcaattcttctcataaagtagctgaaccagtccgttccatatgggacatacacacgcattctgtagccttccttggcgagttccttctgacgctccggcctgatgccgtatagcatttgaaactcaaattgcgacgcggggattcgatgttcggcgacgagctgtttcgtaaatgcaatgatgtcatcgtcatgtgtggcgacagccgtgtagttcccgcttaacaactgcagctttattaagctctgaaaatgaaggtccgttcctcttttgtcgggaaacgctacggccgcagattctttataagcgccttttacaagtctgagattcggctttaagtcccgcatctttctgatatcttctgccgcccggtacagatacgcctgaatgaccgtgccgagcttctcaaattcctgtttgcattgcctgtaaatagaaagtgtctgttcataatgggaatagtcttccatatcaatggtcacagcaacatcatattgcttcgcaacggaaagaatggcgcgcaaatgagtaagagcaagttcttctgaaagatcgagcccgattgaggtcagcttaagtgaaagctctgagtccaattgatgttcggcaatggcttgaatggctttcttgcattcctctgcgacttggtttgcttctttttccgaagctgcatactcgcctaaataatcaattgttgcacacaaaccggatctgtttagccttttgacggtcttaaccgccgattcaatcgtatcccctgcgacaaaccttcgtgctccaagccgcgttccgtatgcttttgcgaacttggtaagtgttttattttgagataagaataaaaacacatgtctcaacatccgactccctcccgccgtcatcttcaaaacacctgtatataactcccagtctgaaggaaactataaaatgaacagaaaccaaaggaggatcacaatggataatcagcagcaatctcaaatgccgccttccgttatttcgacaaaggatcatttgtatctcaatgacatgctgaactggaatttgctcgcgatgaagaaagcgcatttcatggcgcagcagtgccaggatcaaacgttaaagcaagaactcgaccgcgtcggacacatgcatcatgatcactatcaaagaatattaaagcacctgcagccaggccagcagcagtccggctacatccaataaggaggcgccagaatgaatcagcaaaatcaaaaaatcagcaacccgcagacacctgtaccgacaacatcggaaatgaatgacagagatttcgtcaacgaattgctgacaaccgaaaaatacatgacaacagcttattgcactgctttgcacgaattcagccacgagtctctttatcaggatattcaatccatttttgatgagtcacaaaaagcgcaaagaaaactatatgatctcatgttccaatatggatggtattctgttgaagcggaggatgcacaaaagctgcagcagtcctatcaaaaattccagcagaccattcagcagcagtctccttatcagcaataacaacatcagtaaaaaggatacgatgttctttcgggcatctatcctttttttgtgtaaaatcagttgacttttcatttacgcttatttatgtttaataagcattaactattttgtcattaaaatatatatacagtgtatgtaacagaggggaaatgaatatgaagagtgcggatcagttaatgtccgatattcaattatcgcttcaggcgctctttcaaaagatacagcctgaaatgctggaaagcatggagaaacaaggtgtcaccccagcgcagctgtttgtgctggccagcctaaagaaacacggcagcctcaaaatttctgaaattgccgagcgtatggaggtgaagccaagcgcggtgacgctaatggcagatcgccttgaacaaaaaaatcttatcgccagaacacacaacacaaaagacaggcgagtgattgatctcagtcttactgacgaaggagacagaaagttcgaggaggttttggcaggcagaaaggccattatggcgcgctatctttcctttttgacggaggaggagatgctgcaggcggcgcatattacagcaaagctcgcacaagcagcagaaacggatgaaaagcaaaacatgaaaagaggaaacggatgaaaatgagtaaagaaggcaaacaatcaaaacgaacgttattaataacaggcttaattattgccatgtttttttcagcccttgacggcaccattgtcggaacggccatgccgaaaattgtcggtgatctaggcggtttgagcatgatgacctggctgacaactgcatatttgttaacatcaacaaccattgttccaattgccggtaaactggctgatttattgggacgccgcattgtctatgtatcaggtttaattatttttatggccgcttctgctttgtgcggaatggccaacaacatgacagaattgattatcttccgtggactgcagggcatcggcggaggcatcatgatgccgatggcgatgattgttatcggtgacttgttcacaggaaaacagcgtgctaaatttcaaggtgtctttggcgcaatttacgggctggcttcagtgattgggccgcaaatcggcggctggattgtagactcgttaaactggaaatgggttttctatattaatctaccagtcggaattattgcggttatttttattgccagaggattacagggacgccagcagactggtccgatcaacttcgatatcgctggtattttcacaatgattgtcggggttgtcagcctcctgctcgccttaagctttggcggaaaagattatgcatgggattcatggcagattcttgggttgttcgctctcgcactgatcggcattgtcagctttatcatcgtagaatcaaaagcaaaagagccaatcctgccaatgtatttatttaaaaacagaacatttacatttctaaacttgatcggcttctttatgagtatcggtatgtttggcgccattacgtttgttcctttctttatgcagggaattgtcggtgtaagtgcgtctgaatcgggtacaattatgacaccgatgatgatttctatgattattacaagtatcatcggcggacagctcgtttataaaattgggattaaaccgcaaatcattgcaggcatgctggttatggccggcggattcctgctgttaacgacattggatctcaacacgagcaagcttgtcgctacatcttttatggcgattattggtctgggaatgggccttgttatgccgattctgacattggctttacaggaaagcttttcgaaggaggagcttggagttgtcacttcatccagccaattcttccgttctatcggcggaacattcggcattaccatgctgggagccgtaatgaatgcgagatcaggaaatctattaacagataaattggttccatatttagactctcttccggcacaggcaagctcgtttgccgcccagctaaagggtatgattgatacaaatccgcaagggctgctgcaatcactgttcagtccggacgcagtcaaacaaatccctgcggctttctcatcccatattgtgccgattttaaaaacatcgttgatggattcgctccacagcgtgttttatacgggcctgatctttatcgcagtcggagccgtattcaccttgttcttaaaacctatcaagctatcaaataagaaaacggaagaccaacaagaaaaagagaaagcggcaaaagccgttgaatcaccttcccattaatagagcaccccgcgggtatcaatccgcggggttttttattcaatcatctgggctcttccatttccgaaagaccaatcctcagcctgatttccggccagcatgataaacacatcttcttttctgacaccaagctcggaatgaatccggctcgcgattgagcggtaaagtgcttttttctgttcagttgttcttgactgtttcagtgtaaaatgaatgtatatcagttcatcagttcgctcgacttggagataaaatggatcataaaaaaattcgcttttttcatattgtctgatgacttggaaatagtcatcttccggcacattgatttcttcaatcatcgattggtggatagtcctgctcagtttttgaagccacgcttcgcttcttcccgaccgtaaatgaatctgtacaaatggcatctccctgcatccctttctttacagcgtctgtccgctgtcaattgtgataatttggcctgtgagtgattcctgttcaattagtgaacaaatcaatttggcaacatcatctggttcagcaatacactgcagcggcaaagagccgatcatgcttttcattttttcttcccgtccggcccaccatctcgttgccacagctcctggtgctacaccgctcactctgatttcaggcgctaaggcgtgggccaatgatttcgttaaaccgtgcaccgctgattttgatactgcgtaaggcatagatgagccggcaccagttacccctgcgatgctgccgacgtttacgatcgccccggccttgcttttcttcatgaacggaaccactgcccgcgcgcagaaaaacatccctttcacattgacggcatacagctcatcccatatgtcttctgtcgcagcctcaagatcatccattggaatatgccgtgtaatgctggcattgttgactaaaatatcaaccgtgccgtgtgtgttcacgattgcttgaatcatatcctgcacgtcgctgtttttagatacatctgcttggatggcgaaggcttgcccgccagctttttgaatcttttccactgtttcctccgcttctgattgcgagcgtgaataattcaccgccacaatcgccccgcactttgccaattccatactggctgcttttccgattcctgtgccgcccccgttacgagagctattttgttcaagacattcattgccgccactccttgctgttgactaaagtatatttctgattccattgtaatccagctttgatgttacgtataatgattgttaaagatactagatatcactcagattgatagtaaacgaacggaggagttcaaaatggaaagcggagatttacgtgtgtttcaaatggtagctcgtgaagggaccattacgaaagcagccctgcagcttggctatgtacaatcgaatgtcacggccagaattcaacaattggaagctgagctgggtaccacactgtttttacgccataatcggggcatgactctttccgcaagcggaaagttgctgctggactacgcaaataaaattataggcctgcttgatgaagcttctaaagcactctcatcctccgcagaaccaagcgggccgcttatgatcggctccactcagacaaccgccgcggtaaggcttccaaagctcctggcatcttattatgaagaacatccaaacgtccagctgtctttaacaacaggacatacgcaatttctccttgataaagttcttcgttatgaattggatggcgcgtttatcggatgcgaatgccatcatcctgagctcgaatcctatcctgcgtttgaggaagaaccagtagttgtttcggctgcctccgtgcccgatgttgaggaagccatcacaaagccgattctcgtttacagcacaggctgctcgtatcgagaaacacttgaaaaatggctgcgttccgtcggtatcacacagccggtcattatggaatttgggacgcttgaagcaattatcggcggggttacagcaggtcttggcatctcgctgctgccaagaacggttgtgcagaaacatgaagcagaaggatcaattcgattgtacccgctgcctgaagctctcagccagatgaaaacagagtttattgttcgaaaagattcgtttatcagcagcgcgctgagaacctttatggattcctttacgccagataaaacggctgaatcacaaaaaagcagtctgctataatgaacagactgctttttggctattgtttgtttcgatgcgcttcatttaattccttaatatgctgaatgatctctttaatgccctgctttgcgtcagggtatgtcgcattccaatgcttagcgaggggcggcatgcttttggctatatgggtgtacaaaatccattgcttcacttcttcttttagctcatcgtttgtttcaccaagcagaagctcagtatacttctccagcaatccatccagttgctcctgaagtgtttgttccattttccatcttcctttcgaaaaaacagcaaggagctttctcaattgaaagctccttcgctgcgttatttatccatgtgatgtgaaagccgcttcctggacaatgcatctgcccctgccatgaggaatgcaaagaggcgttccgaagagcgggtcctgtgtaacctgacagttcatagaaaacacattttgcacaagatcacaagtgatgacctcttccggacggccttctgcataaatccgtttgtcttttatggccacgagatgatgtgcatagcggcacgccaagtttaagtcatggagaaccataacaatcgtccggtcttccttttcattcagctcaaacagcaaatcaagaatttcaatttgatgcgtcatgtctaaatacgtcgtcggctcgtctagaaggatgatatccgtttcctgggctagcgtcatcgcgatccaagcccgctggcgctgtcctcctgacaaagaatcaacggcgcggtcagccatgtcctcaagctttgttgctttaagcgctctctcaactgcttcctcatcctcttttgaccactgcttcagccagttttggtaaggatatcttccttgcttcaccagctgatgcaccgtcagcccctctggagccgaaggaccttggggcaggattgcgagctcttttgcgacttccttcgtcggaagcttggcaatggctcttccttccagcagcactgaaccgcctctcggcttcatcaggcgcgctaatgaacgtaaaagtgtcgattttccgcagccattgctgccaataaatacggtaatttcacctttgggaattgttaaattcaactcatcaataataacggcatccccgtatcctaagctcagcgtttctgtagaaattgcactcatacccataaccgctcctttttgctggcttttagcagcactatgtattgcacgttttctatatacatgcttttaagtcaattgtcatcaatgcaagtgattccgatattcagccatttgatatggtcatatatccctcattgtagcagaaaacactgactttgaaaatcattttcaattagttttatggacataattgacgtttatgggttttttatcacaagattacttcttgatttctctgatggagccgtccttcagcttcaattttaaatcgatatgatcataatgactgtccagattaaatgctgccagcacactgtgtatcacttctgtttcagccatttggtctgtcacggaaagctcgctcaaaatcattttcatctcatccaatgcttcttctccctcctgattgacaccggagagcttatcctgtatttccgctttttcctgagtcccgttctttgtatagattccttcataacggttatgctcaccatccccatagctcacacgaagcgaaaaattgctgtaaggaacggacttcagctgggtgacggctgtattttctccttctgcctgctgctggtcttcattgagacggcagcctgcaatcagaaccactgcgagacatacagccccggctgctctgaccaaatgcatatgtttcccccctgtaggattccatttattttaggtatatccagagaatgaaatcctcattcagagaagaattgaaaaagccggggcatttaacgccacggctttttctttaagattcggtcatttgtaaaaaggtttcggcgtcacgcacagccagcttgatggcattctcccagaaatcgcgcttcgtgatgtcagcgcccaaatgcttcatcgccaaatcctccactgtcatagaagccgtatctcgcaatagcgccatatacttctcttcgaatgcgtttttttcttcaagcgccagcgcgtaaatgccaagagaaaacaggtagccgaatgtataagggaaattgtaaaacggcaccctcgtgatgtgaaagtgaagttttgatgcccaaaaaagcggatgatattcttctaacgcattgcagtatgcctctctttgcgcctcttccatcagctcattcaagcggctggccggtaccactccccgctttcgttcctcgtagaatctcgtttcgaatagaaatcttgcgtgaatgttcatgaagaacgcaacgcttctttgcactttatcctccagaagaacaagcttttcttccctggtctcggcctgctggacagtcgcgtccgcgactatcatctctgcaaacgttgaagctgtttctgcaacgttcatggcgtaggagcggtttaacggcctgacgttgagcattgcttcctgatggaacgcgtgcccgagttcatgcgcaagggtagagacatttgaggcgctgcccgaaaatgtcatgaaaatcctggattccccgctgtccggaaaactggtgcaaaagccgccgactctttttccgctcctgtcttccgcctcaatccagccgtcccgaaacgctttttcagtgaatgaggacagttttttgccaaacgttgaaaactggctggtaatgatatttgcggcttcatcatacgaatagacctttccgtcagaaccgatcggtgcctcgacatcgtaccagctgagtttttcaaggccgagcatggatgctttccggttcaaaaactgaacgaacggcttcttgttttcagtgatgacctgccacatcgtatcaagtgtttcttttttcatcctgttaatttgcagcggttccttcaggacattctcccaaccgcgcgctttataggtttcaagccggaatcccgccaaatgattcagcgtgctgctgaaaatatcttgcttactctcccaagcttggcggaaacgttcatatactgtttttctgacagtacggtcttgatggtccatcatattctccgcctgaccgacagacaattgcttgttttcaccgttttcctcatacgggatcgtcattttcccgacaatcatattgtataagtcactccaagcgtgatatccgtccaccgcaaggttcccgatcagtttttctttaccggggctaagcttttcggcaaccctctgtcttctttcatttaatatgtaagaaacatcgcgcaatcccggttttgttaacaacctattccacacttcttgatcaatgtccacaagtttatgatctaatgtaacgagcgacgattgaaaatctgcggaaagccggttcatgagtgcctgatgctctatagccttttgatcattgatattctgggcctgaagacaggcaacaaacgcgccggcctgctgaagcttgacggatgtctgttcgaataaatcaagcaacgcggtcagcccttcagcctcttcaggcgattcaggcacctgaaacgcatcagtcctgtcttgaaatgcacgcagactttgtgacagcttctcaatataacctttgaattcttccgattggctcccgcccttaaaaaatgaatcaagatcccatctttggcctaccccttgcagcgccatatcacaaaacccctttccttctttcgttctattatagaacaattctgaattgttgtataaaaatttctttttacaggcgtcatctcctgttcaggatagtacaatagctgtagccttttaataggaggtataggatgaataaaaaaatagccatcgtaacaggagcgtccagcggcttcggtctgctggcagctgtaaagcttgcccgatcatttttcgtgatagccacatcaagacagcctgaaaaagcggaacagcttcgagaattggctgcagcacacaatgtgtctgattctattcacattacagctctcgatgtcaccgatgaacaatctatagtctcattcggaaaagccattagtgcttacgccccgatcgacttactcgttaacaacgccggaacggcttatggaggatttatcgaggatgtgccgatggaacatttcagagaacaatttgaaacgaatgtcttcggtgtgatccatgtgacaaaaaccgttctcccttacataagaaagcatggcggcgcaaagattataaacgtgagcagcatcagcggactgaccggattcccagcgctgtcgccatatgtttcttccaagcatgcattggaaggtttttctgaaagcctgcgtatcgagctgcttccgttcggtatcgaaaccgctttgatcgagccgggctcatacaagacatcgatctggtcaacgtcattatcaaattttatgtcggtgcctgctgacgattcagcctatcatcaatactataaaaagatcctttcctacgttgaaaaaaacggagaagaaagcggagatccccaagaggttgccgacctcatttatcaattggcaacaaaacagcacataaagaaattgcgatacccgatcggaaagggcatcaagctcaccctgctattccgatcgctttttccttggtctgcgtgggagtctatcctgaagaaaaagctattcaaataacctaaattataattattataatttagtattgatttttatttagtatatggtataattaaatcaacagatcacaaggaggacgttatcttatgaaaactgaaaacgcaaaaacaaatcaaacattagttgagaattcaatgaacacacaattatcaaactggtttcttttatactctaagctccaccgtttccattggtatgtgaaagggcctcatttctttacattgcacgagaaatttgaagaactttatgaccatgcggctgaaacagtcgatacaatcgctgagcgcctgctggcgattggcggacagcctgttgccacagtgaaagaatacactgagcatgcatctatcacagacggcggaaacgaaacatcagcttcagaaatggtacaagcattggtaaacgactacaaacaaatcagcagcgaatctaaattcgtgatcggcctggctgaagaaaatcaagacaatgcgacagcggacttgtttgtcggattaattgaagaagttgaaaaacaagtgtggatgctttcctcttacttaggataaaaaaagctgaaccctatttgggttcagctttttgtttttttcttagcttgaactgctttctgtctgcttggtcagtgtcgcgttcaacgttttcgtttttccctttcgcagcacttggattgttgttttatctccgacttttaagtctttgtaaaggatctgacggatatccgcactgctttccacgtctttaccgtttagtttgacaatgacatcctcagatttaatacctgctttttctgccggcgaatttgcttgaacttcttttacataaacacctttgcccaattgatctccaaacaggccgagcgtattttcctgataggtttcaggaacttgtgacatgtcaatcatctgcacgcctaaaaacggacggtccaccttcccgttttgcagcagctggtcaacaatcggctcgacatcattgcttgggatcgcaaatccaagtgattccacgccgctttcgctcaccttcaagctgttgatgccgatgacctggccgcttgcattgattaatgggcctccgctgttccccggattgatcgctgcatcggtttgcagcacgttcatttccaccgtcccttgtgttgtatccacatcaattgtccggttcagtccgctaatgatgccttgtgtcaccgtaccggaaaactgctgtccgagcgggttaccgatagcgattaccttttcgccagtgcgcagctgtgaagaatcaccaaagctcgccacttttttgacgttcttgctactgatttccaaaactgccaaatcagtaatggtatcgctgccgacaagcttggcagtttccgtttctccgttgtatagcgtaacagtcagcttgttcgcgccttcaacgacatggttgtttgtaatgatatacgctttatcgctgtcttttttgaaaataacacctgacccggttccgctttcactttctgagctggagcctcctcccgtgccgaatgtgttattttgagaggtttggatatttgagattccgacaatcgtaggctctaaatcctctaccatatcagcgatgtttgatgcgttcgttatcggcgccgttgtaaaattatcagactgcacctgtttatttgcggaagcggtttcggtcgcctgattttggtctgacggcagataaggcgtgatgccaagcatgaggcccccgccgataataccgcctaaaatcgggctcagccatgcggctctccgtttcttttcttttttcacagccgtttcttgcttttccatttctaaagcagaagccgtttcctgccgtcccgcttcatacgacacaggcgcgtcaagcaattcttgttcagaatgtccaatcagcttctggttttctgtattctgctgttctgtatgtgaaggttcagtttgatgttgatcgttttggccatcacgtcgataatccatgttcttacactcctttaacggttattcatttatcgttacatattcatcgcatgtacaagttcaattgtcccaataatgaggagaaaagcaaagcaccaaaatagaatatgtttgatcatcctacatcttcctcgctctttttctcttcctttcttcccttatacatatcataaacaaacattgtgggataaaaatgaaaagaatatgtgaaattatgaaaattgcctgccgtatgttaaaactagtttataatgacgttgaaaggatgtgaagagccttgtcatacaccatttatctagttgaagatgaggataacctgaatgaactgctgacgaagtatttagagaatgagggctggaacattacatcttttacgaaaggtgaagacgccagaaagaaaatgacaccgtctccccacctatggattctcgatatcatgctgccggataccgacggctatacattaataaaagaaatcaaggcgaaagatcctgacgtgccggtcatttttatttccgcccgagatgcggatattgacagagtgcttggcttagagcttggcagcaatgactacatttccaagccgtttctgccgcgggagctgattatccgtgtgcaaaagctgctgcagctcgtatataaggaagctcctcctgtacagaaaaatgaaattgccgtctcctcgtatcgggtcgctgaagacgcccgcgaggtctatgacgaaaacgggaatatcatcaatttgacgtcaaaggaatttgatctgctgctattatttatccatcataaagggcatccgtactctcgtgaggatatcctcctaaaagtgtggggacatgactacttcggaacagaccgggtcgttgatgatctcgtccggagactgcgcagaaagatgcctgaattgaaggtggagacgatttacggtttcggctacaggatgatgtcatcatgaaaaacaagccgctcgcgtttcagatatgggttgtcatatccggcatcctgttagcgatatcgattttactgcttgtgttattttcaaacacgctgcgagattttttcactaatgaaacgtatacgacgattgaaaatgagcagcatgttctgacagagtaccgcctgccaggttcgattgaaaggcgctattacagcgaggaagcgacggcgccgacaactgtccgctccgtacagcacgtgctccttcctgaaaatgaagaggcttcttcagacaaggatttaagcattctgtcatcttcatttatccacaaggtgtacaagctggctgataagcaggaagctaaaaagaaacgttacagcgccgacgtcaatggagagaaagtgttttttgtcattaaaaagggactttccgtcaatggacaatcagcgatgatgctctcttacgcgcttgattcttatcgggacgatttggcctataccttgttcaaacagcttctgtttattatagctgtcgtcattttattaagctggattccggctatttggcttgcaaagtatttatcaaggcctcttgtatcatttgaaaaacacgtcaaacggatttctgaacaggattgggatgacccagtaaaagtggaccggaaagatgaaatcggcaaattgggccataccatcgaagagatgcgccaaaagcttgtgcaaaaggatgaaacagaaagaactctattgcaaaatatctctcatgatttaaaaacgccggtcatggtcatcagaggctatacacaatcaattaaagacgggatttttcctaaaggagaccttgaaaacactgtagatgttattgaatgcgaagctcttaagctggagaaaaaaataaaggatttattatatttaacgaagctggattatttagcgaagcaaaaagtgcagcacgacatgttcagtattgtggaagtgacagaagaagtcatcgaacgattgaagtgggcgcggaaagaactatcgtgggaaattgatgtagaagaggatattttgatgccgggcgatccggagcaatggaacaaactcctcgaaaacattctggaaaatcaaatccgctatgctgagacaaaaatagaaatcagcatgaaacaagatgatcgaaatatcgtgatcaccattaaaaatgacggtccgcatattgaagatgagatgctctccagcctctatgagccttttaataaagggaagaaaggcgaattcggcattggtctaagcatcgtaaaacgaattttaactcttcataaggcatctatctcaattgaaaatgacaaaacgggtgtaacataccgcatagcagtgccaaaatagactgtagatgttttgcagtctatttttttatgtgaaagaatagccgttaaaatctctgtaatttgttttgagcggctgtttgcattgatgaacccattttttctctgacaaggtctgcttcggatatttgactttctccactttgattcctctgtttcgcaagcggctgatcatttcgtccaattctctcattctagattcaccctttcgcttgagctttgaccattcggtcatctcaatttataatataaataatacatgataaaaaaacaagttacaataaggttaattttataacagacggtgtgactatatggtcatatcctagcaggcctacgggctccgaaagggtggaaccattgaaggaaaaagaaaaactgattattgaaacagccttaaaactatttgcccaaaaaggatacaactcaacatcagtccaggaaatcgcaaaagaatgcaaaatatctaaaggcgctttttatatttattttccttcgaaagaagcgcttcttctctctatgctgaactactattatgataaaacgtttacccgaattttaaatattaaaacgaagggcgacagccccagaacggcttaccgtaaacagctgaccgtcctctatgaaaacattcttgaacacaaagattttatcagtatgcagttgaaggagggttctctgccttacacagaagaagtggagcaatgcgcaaaaaaaatccgccagtcctcacttcaatttcatatcgacagcctgctgaacatctatggaaaaaaagcggaaccgtacactgctgagctttgttttttaatagagggcatcagccagatttacctggaatgcatgattttgctcgggtacactgtgaagccgtctcaattagctgatatcattatgaatcgaatagatgatatggtaaaaggcatgtctgaacgaaacgataagcctttcatcacattggaagaggcgagttctttattcgggcctcttacgcacggacggcctgacccgctgactgaatcgattgtgaaaagcctacgtgacaaaattaacagcttaaacacaaactcctctcttgaattatcggagagcttggacatacttgaagcagaaatgaagaaaaaaacaccgaagcttgtgatcattaaaggaatgattcataatctgacggagtctgaagctctcgccaaagatgcggaacagcttaaatatttattaaaacagcaacatatttagaagaacggctgcttaaaaagcagccgttctttctttctattacgcctttggttttaccatgtcttccggcttaaccatttcgttaaattgctcctctgtcagcaattcaagcttcaaagctgcttctttgagcgtcaatccctctttatgtgcaagcttggcgattttcgccgcgttttcataaccgatatgcgggttcagcgccgtaacaagcattaatgaatttgacaggttttcctgaatggtttctttattaggctcaataccgacagcacatttatcatggaatgaattcatgccgtcactgagcagctgcacagattgcaggaagttgtaaataataacaggcttaaacacgttcagttcaaagtttccctgactcgcagcaaagccgattgtagcatcgttccccatgatttgcgctgcgatcattgttaacgcttcgctttgtgtcgggttgactttaccaggcataatggagcttcccggctcattttcaggaatgacgatctccccgatgccgcagcgaggtccgcttgcgagccatctgacatcgttcgcgattttcattaagtccgccgcaagcgcttttaatgcgccatgcgcataagtgatttcgtcatggcttgtcagcgcgtggaatttattcggtgaactgctaaacgtttggccggtcagcttagtgatctcttctgagacaagctctccaaactctgggtgggcgttgatacccgttccgacagccgttccaccaattgcaagcgcacgcattttatctgtcgcttccaaaatcatttccttcgaacggtccagcatgtgaacccatccgctgatttcctgtccgagggtcagtggcgtagcatcctgaagatgcgtgcgtccgattttgacaatatcattgtatgcttttgctttttcatccagtgtattgcgaagctgatcaagcgccggcacaagctgctcgtaaacagccaaaacagcggcaacatgcatcgccgtcgggaatgtgtcgtttgagctttggcttcggttcacgtcatcatttggatgaatcgtttgatcagagttcttctcttttaataaagcagtcgcacggttggctaccacttcgttcatgttcatattgctttgtgtgccgcttccggtctgccatacgacaagcgggaagttgtcatcgtacttgcctttgagcacatcatcacaaaccgctgcaatcgcttctgctttttcagcatccagattgccgaggcgtttattagctagagctgtgcttcgttttaatattgcaaacgccttcacaacacgcatcggcattttttcagaaccgatcttaaagttctccttgcttcgctgtgtttgggcgccccaaaatttatcagcaggaacttttacttctcccatggtgtctcgttcaattctgtattccatttatgtatccctccataacggttgcttcaatagatcataattcgccaatgacacaaaaaatcctttttatttttcgatcttggcagattttaattttaattcaagatatacgcgggaatcctttgaatatttgtattttggattcgtccttccgtactcctttgatgtataagagacatcataatgcttttcaaatgatctaatgagctgttcaatttcttcttgttttccagctagccttacctgtgccacttcgtatcctccgctttcataaaaaaacttactccatgaaatactctaacacagtatatcatttttttaacaggaaaagataacctctactaaggttttggataagaggtgacctcattggaacaaacagagtttaaggaatatatacacgataatttagcattggtgctgccaaaattaaaagaaaacgatgatctggtgaaaaacaaaaaaatgcttgcgaacggactggttttttactatctctatttcagtgaactgactgatgagaataaggtgtcagaagccattaaaactttaattaaagatgaggagaccttaacgcttgaccaggtcaaaaaacgccttgaccagcttgacgcaagacctgttgaaaccgcaaaaaaaacgattgaatcgattctcaacggcaattgtgctgtgtttatcaacggattggataaagcctatattctgaccacaggaaagaaaaaaacaagaagcctgacagagccgacaactgaaaaagtggtacgcggcccaaaagttgcgtttgtagaggatattgatacaaatctcgctctgatcagacaaagaacctctcatccgaaattgatcaccaaaaaaatcatgatcggcgaaaacaagctgaagcccgcagccattatgtacattgagggcaaagcgaaaaagtccgtcataaaagaagtgaaggcgcggcttaaaaatatccagctggaagatatccaggacagcggaacgctcgaggagctcattgaagataataaatattcaccatttccgcagatacaaaatacggaaagacctgacaaagtatcttcagccctgtttaacggccgtgtggcaattttggtcgacagttcaccatttgtgctgctggtgccggtttctctcggcatcctgatgcaatccccggatgactactatgaacgctggatttcagcatctcttatccggtcgctgcgctttgcttctatctttatcaccttgtttttgtcatcgatttatatagcacttgtttccttccatcaggggctgctgccgaccgcgctcgccgttacaatttcggcgaacagggaaaacgtgccgttccctccgatatttgaagccctgctgatggaagtcaccatcgagctgctaagggaagccggactgcgactccccaatccgctcggacagacgatcggcctcgttgggggcgtagtcatcggacaggctgctgtagaagcgaatctcgtcagttcgattatggtcattgtcgtcagtgtcattgccctggcatcctttaccgttcctcaatacggaatgggtctgtctttccgggtgctgcgttttatttcgatgttttccgccgctattttagggctgtacggcattattttatttatgcttgtcgtttatacgcacttaacgagacaaacgagctttgggtctccgtatttttcgccaaaaggattctttagcctgaaaaatacggatgactccattatccgtctcccaattaaaaacaaaccaaaagaggcgaataatccaaatgagccaaaaacagactccactgaaacttaatacctttcaaggtatttctattgttgcaaatacaatgcttggggccggacttttaacattgccgcgagcgctgaccactaaggctaatacgcctgacggctggatcacgctgatattagaaggtttcatttttattttcttcatttatttaaacacgctcattcagaaaaaacatcaatacccttcactctttgaatatttgaaggaagggcttgggaaatggatcggcagcatcatcggccttttgatctgcggctatttcctcggcgtagccagcttcgagacacgggcaatggctgaaatggtgaagtttttcctgctggagagaaccccaattcaagtcattattttaacgtttatttgctgcggtatttatttaatcgtcgggggtttaagtgatgtgtcgcggctgtttcccttttatttaacggtaaccattattattttgctggttgtgtttgggatcagttttaaaatttttgatatcaataatttgcgtcctgttttaggtgaaggccttggacctgttgcaaactcccttaccgtcgtttccatctcttttttaggaatggaagtgatgctgtttcttcctgaacatatgaagaaaaagaaatacatgttcagatatgcgtctctaggatttttgattccgattatcttatatatccttacgtatattatcgttgtcggagctttgaccgctcccgaggtaaaaacgctgatttggccgactatttctctctttcagtcctttgagcttaaaggcatatttattgagcggtttgaatcgtttttactggtggtctggattatccagtttttcactacatttgtcatttacggatactttgccgctaacgggctaaagaagacattcggattatcgactaaaacaagcatggtgattatcggcataacggtcttttatttttctctctggccggatgacgccaatcaagtcatgatgtatagcgattatcttggctatatttttgtctccctgtttctgcttcccttcattctctttttcattgtagctctcaagaggaggattacagcaaaatgaaaatccggattttatgtatgtttatatgcaccctattgctgtccggatgctgggacagtgagaatatcgaggaattaagcttagtgatcggagtagggctagacaagcctgacgatgaaaatttagagctgacacagcaaattctcgtgccgaaaaaaatcagcgctaaggagggctcttcatctgatccgacacagctttctatcacaaaaggtgaaactgtccatcaaatgatgagaacctctgcattaaagcataatcctacgttttcacagcatttgcgtctcattctgctttccaaaagcgtgattgcggatcaaattggaatggacgcgatcattaaccagtttgtcagagacaacggaacaaggaggagttcctacgtctttatcaccaacggccgaactaaggatatatttaaaatgaatgatgaaggcgaacccgcatccaacgtgatatatgatctgacagagaataataaggtgacaatcagaatgatggagccagttacattaggggagatctcagaacacttaacctctgacgattcattcctcatccctcatgtcggtaaggaaaacggcaagctcgcgataaacggagcctctatcatcaaaaacaaattatggcaccgggatctcaccccgattgagattcaaaatatcaacttattttcaggcactgtcgaaggaggcgtcattgacttgaagcgcgatggccatctcttttcttatgaagtatattcgagcaatcggaagatcaagacggcatacaaggacggaaagttcaaattcaccattacccgcaatattgaaggtcgtctatctgaggactggaatcccaatgaagactcgtttaaggattcatatattaaaagtattgaaaagacagtcgaaaaacgagtacacgaaacagtaacgtcatttattacagagaagctgcagaaagagatcaaagcggacgtaaccgggctgggaaacgaggtcagaattcattatcctcaaaagtggaaaaagatttcaagaaaatgggatgatgattatttcagcaatgcggaaatagactaccgggtcaatgtggttgtcagagacttcggaacgaaaggcgccaacaaatagcagccgcctattttacgagatggtttcgatgtgcgtacactgccgcctgcgtccggtcactgacatccagctttgataaaatattcgtaatatgcgttttgactgttttaatcgtaataaacagttcctcgcctatttctttgtttgtctttccttctgcgatcaggcagagtatttcgagctcccgtttcgtaagtgattcatgcgggagcgcgttttcacctgagtggcgcagcctggataatacttttcccgccacttttgactccagcttcggctctcccttgcttgcggcgcggatggcatcggcgatttctgccgcttttgaggttttcaacagatagctgagcgcgccagcttcaataaccgggtacactttgtcatcatcaatgaagctagtgagcacaataattttcgggtcggaaagctcccggcaaatttgctttgtagcttcaatgccatccatgccctccatgacaaggtccattaaaatgacatcaggcgacagttccgcagcaagccgaacaccttcgctgccgtccgatgcttcgccgatgacttcaatatcgggctgcgcctccaaaaaagccgcgagccccattctgaccatttcatgatcatcaatcaataatactcgaatcacgttcgttctctcctttttcttccgggaaaatcgggaccttcacttcgatttgggtgccttttccttctactgaaatcacttcggcgaccccgccgatttcacttgcacgttctttcatagaattcaagccgtatgaggaggctttcacctggtccattttgaagccttttccattatcaatcaccttcagacggagctggctgttctttatgcccagaatcacggttacttttgacgcttttgaatgtctaaatacgtttgaaagggcctcctgcacgattctgaacaaatggtcttcaacacccttggatatcgctgtgtcctgtatatcccactcaatatcaatcggctgcttttttcggaactcgtccaaaagctccgtaaggccctccttcagcccttttccttcaagggtaacaggccgtaaatggagcagcagcgccctcatctcattttgggcttcgcctgccatatgctcgaccatcctgatccgcttgactgttttgtcatcagcacccttgacatgttccagcacggctgatgtcatcatcgatatggcaaagagctgctggctgaccgcgtcatgaagatctctggccaatcgctggcgttcttctgagataaccgacttcttcatttgcgcctgccattccgcacgttcattggaaagtttctgcagggatgcgacttgaagctccacgcgcttcgccatttcgttcagctgatcggcggccaggccgatttcatcatcaccgagcggcggtattcgataagcgaaattgccgttttcaaaggttaaaatggattcaattaatgtatcaatccttgtctttaaccggttgccgtacatataccctgaggcgaaaccgacggtcacgctgatcagaagcaaaatcaggataaacggaattccgaaccagcttgatgacagcaaaacaagcggatcgagccgatagtaaaacatcataaaggaaatcaggcaggcaaaaaggagcaggctgattcccgttgtcatgcggatggcgcgccattggaggctggcaagcattttttttctcatacgtacttcacatccacatcaccgataaataaggaaacggacactttgacccggcgctttgactcgctgaaatcggttgacgcggcatataccttcgtgcttaatccgcttttcttcgagccaatcagattgatgtctcctataaaaacagccgagctgacagccacttcaaggtccgatggtacatatatatcaacgtttccaatgactccgctaatgacgattgtgctttctccctcgggaatcatcgctttagacaaatcgattttgatatcaccgataaaaccagagacatttaaatcattcaggtcaaacggctgcttcatcatttgcagctctccgataaaaaagctgcgcatgtcggaatgttttacatcttttggcgtctcatgatgttcttttttattgagattgacctgtttctcattcggttcaaatatcggcttccctttgataagcctgtagccggcataaatcagaaatgcggcaaacgcatagccgaataaattaaaggtgatgctgaagaggtttttcaaaaatagaaacgcggcaaagatatacatgacggagccaagccaatcacgggaatattttttaaggaaatagccggcaatcagaaaaaagagcggccaaaacagcagatcgcctattccgataatttgcaaaaacatactgatgccgaataaagcaatgatcaatccgagaagctgtttttttgtcattcctggtgtccgcctcctttcttctgcctggtgctaccgtatcgctagatccccgctgtccgttttaatgtcgattggatgccggccgcttccttgcgtgcctgtgatgtgatgctgctctttatgtgctttatcagcaaatgaatacggcgaactgacgtcaccgctcgctgatttcgctttgactgtaaagctgccgtttttgggaaggcttagattggcatcaccgcttgtcagcgtgacagatacggggccggttatctttgtcaatacagcattaaaatctcctgaagtcattttcacatcaagagagcctgatacatgaaccagatttgcgtcccctgaagctaaatcaatgccggatgttttggagacggtatttgaaatggttacatcccccgatgacgccttcactttcaggtcttgaaggcggacgtccgtcacgctcgcatttccgctcgcagatactgcgttcagcccggaaagcgcaagatggtgattcccggccacagacacgtcaccgcttgaggttcgtactgccagatcacctttataatcatacggaagcctgacgataagagttgaacggttaaacccattcaaaaattgaaattctttttcctttacggtcagctccagttttcttttgttttcagtaacaaataactttcctgagtctcctgaaatgcctgccgatatgtcacttcgttcttccgctataatccggacatccttgctatccgactcaatgaccatgctgtcaatgtcccgcggcgatgcgctggctgaatcggcttctgtgccatttatgaaacccaggcctgcagcaaacacatcttttacgacgacggcgaaaaaaaccagaataccggcagtgatcaacagtttgccaagcatttttttcattcggtttcatccttctcattcattctattataaaggaaaagcttgcgaattgatacgtgcggaagggaaggacttgaccgcaaatccttccccgttccgcttattcatttgccgcttttgtctggtctgatttttgcagtgaaagtgtccgcattttttcaatctccgcttccacatcgtctgcgaattctttacgtgtaagttctgtgccggcttccgctgactttgaataattcgcgcggatttccatttcttcaatacgattttcaatacgtaaaaattcacgatacgcgctttcactgtcaattttgtcaaatgtcgtattcatatgctctttagctttcgccgcatttgcccgcgcaatcagcgcctgttttttatcctttacgtcctgaagctttgtttcaagtgccgccagctgctctttcaggtcagccagctgactgttagcctgttcataggaagctttatgctcagccgccttcccttctaaatacttcatttcagtcagcgcctttttcgccagttcttcttcacctgcgtcaaatgcgagctgcgcctgatttttccgtttgccagccacttcagcggcttcttcatattttttcttaaattgataggcaatcgtgtgctgtttcacaattgtttgctttgcttttgcgatgtcgctttccatatcgcgtacatattgattcagcatcacctttggattctccattttatcaagtccttcatgaactgacgcaacaaacatgtctctgattctttttaataccatacctgattcctcctaatatattgatattattttttcttcaaaaattcttcccattcgtcatcaaagtgagattggtaagcaacagaagccggttcaggatcaaaagatgatacaccgttatcagctgatccgtttttcatcagcttccagccgtaataaaccatagcggctgccaatgcgattccgacgacaaacggaagtgagcagatgagcataatggctccgataccgcccacgatgattcccgtgatggtttttcccgcggcaaaccttttgactcctgcgtatgtcattaagcccccgatggcgagcgggatgataaagccgaagcttcctcctccaaaaaagacagagatcccaaatacaattaataagaatccgcctattgttttcttgtttatcttcatgcagatcctcctttcgttttccttgtcttcatcttatacaagttggaagatatgcaaaacgaatcagagattgatttttatataagaccggagtcgtatctggcaccggacccatcggcacaaaaaaacgccatgcacgaggcatggcgtttcaaaaccctttacagatgaacacttgcttccctttctttaatcaggtcggacctttctgctttggccagttttgtaaacagcaagattccgatacccgcaataatttctacaatcccgccgacagcgatcactttacctgagccgaaagcatttgcggcatacccgcaaatgacagctccggcagggatcgaaatatttgagatcatatgtataacggcgtaaacctgcggctgatcctcactgtccacagacgtctggataatcgtatactcaggaacattaacagcactgactgcggcgccaaaggtaaaagcagcgaaaaagacgagcggcaaaaaggtattcatcccggtaataaagaaagcaaatccttcaataatgccggcagtgacgaataacaagccgtacctgtttaccttgactttcgccagcacaaaccctaataaaaacgcgcccgcggcggtggtggcctttaaaagcgagtatacgatcggctggccgtttaaatcttccgcaacgtatacggcagagagcgcttcccatggggcagccgcgaaattcataaagatacagtaaatggcgagcggatataaaatctggtgttttctgacgagcctaaagccgcgtttcagtcttccgatatatgtgcctctctgtgtaacaactgcagactctgattgagattcaaccgcagtgtacttaataaaaagaacgagaaaacccgacaccaaatagagcacaagtgcgataagcatggtataagaaggactgataaatgtaagaaaagcgccgcataatgtgacagccccgagccgaacaatttgagcggaggattgcagcacagcgtttgctttttgaatgccctgttcattgacgatttgaggaatcaaagcgatagaggcgggattgtaggcagctccagtagctgaatgcacaatcataagcgtcatgacaaaccacagcggagagaagcccgcaaaatgacatagagggataatcaaaacaatcgccgcccttgtcagatctgaaaagtacatccaaaatttcagcgtggtctgtttcataaaaggccccgtcacaggcgccagaacggcttccggcaaaaaagtgacagcaatcaataaagcagtgccgatcgcacctttgccgtcataaattaaaaaccataatattgaattaaatgcgaacatatcgccggatatcttgactattcttgagaaaaacagataattgaaatttctcttccagatgctatcactttcaattaaattcaccatccatcagagcccccccgttgcctattttttacatctatttattacaatatctcatttttccatttttcagtcaataattcataaggttcattttttgtcgtaaaatgggaaattgacagagtgaaaaacaaaaaaagccggcatgtatttgaacacgccggctttccttttcactttttatgattcgctgctgtttcggtcccgaaacacaatggcacttctttcatattctacatcgccaataccgcttcttgcattcacaacccgggcggcggcaaagaaataatcggacagacgattgagataacgcagcactgtttcatgaatctcctccgatttcatcagcgccaccactcttcgttctgcccgccttgtaatggtgcgtgcgatatggagaagcgaagcaccctttgatccgcctggaagaataaatttcttcagttccggcgcttctgctgtataggcatcaatgcgcgtttctaaaaaggaaacagattcttccgctagtttgtagtcttttctttctgtgacgattgccagatcgcctccgcagtcaaacagctcatgctggatggtcagcagctcggctgtcagatcttcaaagccgggctgcccggaaagctctgccaaagcaagcccgataaagctgttaagctcgtcaatcgtgccgtagctttcgacgcgtaggctgtccttgtccgttctgcccccgactaagcccgtttgtcccttatcgcctgtttttgtatatagtttcataccctgaatctcctttacagacttattcaaacaactcagcagcctcttttatacattcagctgtccctttctttatcaattggttcagccgctgttctatgttttctgattgctgagtttgagtcgcggcgatgagaatatcacctgtgcctcctccgtctcccagcactttcgtccgttctgcttcggcagccataagagctttgatgaagaattgatctgccgcatagccgttaatcaaaatccaaatcgaaaagccggtctgaacgcatataaaaacggataactctccgtcttcatatgttcgatacacgaaacggtcaagtctttctgaagaagccatcgcacacgtctcctgcagttgaaaaccgctttctgaaagacaggccgtaagtccttctatcggatctggctgatctggcagccgtttatggatcagcgtcctgctccacgaaaaccctgcaccgataggcgtcgaggacaatgttcgaagcgggatttccgttttcagaagaatgtcatcacgtcccgcttggagcaatgcttcaaatgggatagactgccgcttcacgctatctttttcaggctgaatcacaatcatcggtttaggtgagctttgatgtaccaaggcggtgacatctgtatcgtacaccgcctttatgctttgttctgtaacagcatattccggtttttgcttaggcccggcggtaccgtttttcataaacatgagctcatcacagtacaggcttgcggtgttcagatcatgaaaaacgctgacagctgccaatccgctttctctcgtcaggcgtttgatcagatcaagcaggtctttttgataagccagatcgagaaaattagtcggctcgtccaaaaataaaatacgcggctgctgcgccaaagcttgtgccaaatacacccgctgctgttcccctccgcttagttcgcgaatcggcttttgcgcaaaatcggccactcctgtttgctccattgcttcctgtacaatggcttcatccttttcagtctgctgtctgaacagccccgtttggaatggatatctgccaaaggctacagtttcttcgacggtaaaggtgaaggcttgatccgttttttgcggcaggacagccatgatttgggccagttccttcggtttatagtccgccagcagttttccggccagataaaccctgccttccttggccggcagcgtacctgtcagcaagtgcaaaagcgtagtttttccgcttccattggggccgagaattccgagaaattctcccttctccacggttaagctgacattgttaattaggcggctgtcgccgtatcctcccgacagcccttctgccttcatcataagcttctccccccgcggtgctgccgaattaaaataagagcgaacacaggcgctcccgccaaggacgtaatgatcccgatcggcagttcaatcggctcaatgatggttctggaaagcagatcggctaaaacaagaaaccctgccccaagcaaggcggacagcggcagtaaatgccgatggtccgttccccacaaaagccttgtgatatgcggaatcacaaggccgacaaaaccaatcgtacccgatactgccacagcgcttcccgtcaaaagagatccggctattaaaatcatcatcttcctctgctgaacgctgactccaagaagctttgctttatcttctccatatgtcatcacgttcagttcccttccgtttataatcaataaaatggttcccaaaagaaaaaacgggagaaacaaaataacatagctccagcccctcattgagacgctgccaagcagccaatgcacaatcggaagcaggttgtctcctgtcaaggcgatgataagagaaataaatgcgcccaaaaaagagttggtgatgacaccggtcaaaatgagggtggaaacagacatcgaagcatgaacgaagcggctgaagaaaaggaccgccgccatcgtggccagtgccgcggctacactcaaaaccgggagtgtaaaccctccgatgacaggaaggtgcaaacctaagaacagagtcacaacagctccgactgaagcaccggatgacacacctagcgtatagggatcagcaagcggatttttcaacaatccttgaaaagcggcccctgcaatagaaagagccgcccccacaagggcggccagcacaactctcggcagtctgatattcatcataatattagtgtacatcggatcatcagaaccgatagagccgccgaaaccttgatgccaaaagacacgaaaaacagcgggaataggaatatgcaggctgccgcaagaaattcctaagatgatgctcacggctaaaaatgagaaaccaatgatatatgcggcataacgattattccttaaacgtatccgggtaaatgctttccgcaagttcttcgaccccttcgatcagacggggaccggaacgtgtcacaagatcagggtccacatcatatacacgatgatgtttcacagcattgatttcgctccagccatcgcgtttttccacagctttcgctttcacaccgtccgttgtaacaattgcatcaggattgagttttacgatcgcctcgtctgtcatttgcacccatcctgtctgatccgcagctgcgtttttagcatggatgacattcagcatttcattcataaacgtatcttttccggttgtataaatgtcaggattaggagaaacctcgataaatacgcttttctcctcgtcctttgaaatgtttttcgctttttctttaatatcctttagatctgatttcatgcttttcacgagctgatcggcttttttctccgccccggcagcttctccgatcatttcaattgatttgtatacctcggagaatgattgtgcatcattgacagtcagcactgtaatgcccgcgtccttcagctgtttgatggcatccgatgatgctgacatggaagactcatgggccagaacgagatctggttttagagaaatgactttttcaacgtttacattcatatctccgactttctcaacctttttgacttcctttggataggtatcgtttgtggtgacaccgaccactttgtcaccaaggccaagtgcgtatgtaatttctgtgttgctcggcattaatgaaacaatcttttttggctcttttttgatggttacatcttggtttgacgcatcatcaatggtgacaggaaacgcttctgttttttgttttgtctttgaatccttctgatccgcaggattgccgcagcctgccagcataacagcagccaacaggagcgcagtccatatcccggctcgttttttcataatcttttcctcctaaacgaactaaaaaagcatctctacgacggtaaagatgctgtaaacaacacaaaaaagcctattgtttacacatcatctgtcctcgcagaattcgtgctgatcaaacaggcaggtatcctggctcttggcgcttggccaattacagtggcgggaccgcaccggcttttaccggtttcccttttaagccggctgttgttcacggaccggcacctatttgacattcgtatccttttttcggagtaattatactatatgactgacaggcttgtatatgtgtcctgaatgacttttccccatattgtgtatgggagcaaaatcctcgtaaacactaaatttgatcttgtatacttaataccatcatcaatcaaaaggaatgattcttatggatttacagctaaatgacaaactcgtcttaatcaccggctcgacgtccggcatcgggaaagccgccgcaaaaagctttctgcaagagggtgcggcagtcattgtcaacggacgcaaacaggagactgtcgatcgcaccattgaagagctttctggctatggaacagtgcacggtgctgctgccgatttgtcaaaaacagatgaagcagcggcttttatcgaaaaagtaaatgaaatcggtgatatcgatatccttgtcaacaaccttggtttcttcgaggtaaaagacttcgccgatgtgacagatgaagagtggaatcaatatttcgaagtgaacgtgatgagcgccgttcggacaagccgtcacttccttccaaaaatgcttgccaaaaacagcggccgtattttaaatattgcaagtgaagcaggcgtcaaaccgctgccaacgatgattccatactcaatgacaaaaacggcgctgatcagcctttcaagaggaatggctgaaatgacaaaaggcacaaatgtgacggtcaactcagtgctcccgggacctacttggacagagggcgtggcatcctatatggaaggcgccgcacaagcagccggccaggatacagatacatttatcaaagactatttcaaggtcaatgagccaacttcgcttattcagcgatacgcgacagcagaagaagtcgccaacacaatcgtattcctcgcgtctgacgccgcatccgccataaacggcactgcacagcgtgtggaaggcggcattatccgttctctgtagtataaaaaaaacgcatccgtgtttcggatgcgtttttttatacgtctccagcaaatggtaccggctgatatccgcctgtttccagttgtgctgaaaacaaccctccagcgtgaggctgctcgtatctctctttttctgtcatttgttctgttgccgttgtaatgtaaagagtttttaagtctctgccgccgaacgcgcagcacgtgacatatttagccggcacgctgattgaattgatttcttttttctgaaacgggtcaatgtgaacaacgcggctgccgccaaacagcgccacccacagcatgccattttggtcaattgtcatgccgtccggcaatccgtccgactgatcaaaacgatagacaggttctggattcgaaacatctccgctttgaggatcatagctgtaacgcacaatctcctgcgtcggcgtgtcgatgtaatacatcaaattccgctcgcggtcccaatccaaaccgtttgaggtggagacttgatccttgattttgacaagactgccgtctagattcaaacggtacagcgacgcctgtttttgctcgccttccatgctcgtcgtccccgcccaaagccttccgtacgggtcacatttagcatcattaaatctcaggctctcatgcatgtccttcggctgtttaattttttccaagctgtcatcccgaagatgatacaggtaaaacccgtccttcatcgtcataatcagttcatcctttgaatatttcgcaagcgccgtcacaaaggatttgaatttgattgatcggttgattttttcttcagggtcaaagatgtggagctcgctccccaggatatcaacccaatataagcggccgttttcttcatcccataacgggccttctccaatcactgcccgagtgtctgcttccaatactgcatccatgtgttacacctctttagcttcagtctatatattgttattcccggcaaagaggtgtccaaaccacatgatgtttattgttttttaaaaaggatggtaatgaccgttccaatgtccattctgctgttcacatggatcgttccgttatgcagatggacaagctccttggcaatcgcgagcccgagacccgttccggcagttgaatcttttgtgttcgtccctctgtagtaacggttaaacaaatgggtaatggtttcttcatccattcctttcccattgtccttcacctttaaagaaatatgattttttgtttgctccagaatgacttgaatctctgttcctttgccgttgtgcttcacggcattcccaaggaggttttctaatatgcgcctgaaccacgcttcatcaagggcaaattcaatatgctcttctttggatacaaacgagatatcatacccttcagaaaacggatttttcttaaaatcctcaatgacatttttaaaaaacgggataaggctagtgagctttctctcaataggaagagcatcatttttcagccgatacgttaaatttaagtcttcaatcagcttggacatgtattcagatttttctctgacaacctgccccatttctttcacttcttccggcgaccagtcatactgcttcgactcgagcatcatgctgtagccgtaaatgctgctgagcggtgtttttaagtcatgtgacaaaccggcaatccattcttcccttgtcgcctggattttttctctgtttcttttatcccttctcagcgtttcagtcagctgatccattgattcaaatatctcaccgaagaagcggtacggctgtttgatttttccctttttatttttgctgacaggacggccttcccggtttctgggctcctcaagcttcccttttgacagattgaccagccatctaatcgtgtgaaaaatcggcagcccgaatcggaacatataccaaacggtcatccaaatgatatacatgaacaaaacggccatcacgagaaacatcgcttttaatacaaccttcaggaatgatttgttaaactcctgatcggttacatagactgggttcggcaccgtagcgaccatccatctgtctttattgaggatcttaacggaaatttcccgcttatagttccaaggcttagagctgtatttaagcagctccagctggttcatcgtttttctctcgctttttgtgctgttgatgctgtcgagaatctttccattgctgtctaacaggtaaatggcgccttttttccgtttaatatagtcgatggtactggacttatagtgcgctagtgagtctatcttttgttcgcgcttttcaaccgacgtcaggagctgttcactttttgatttccagccggacaatagaagatacgacttatcttcaatattgatggcccaataattcagtttatagttatgaagctttttggttttataaatagacaaaagctctttcttggtataggtgcccggcacgtcttttggcacgccgtaggaataatcagtgtttccttccgaatcaatgatttgcatccagccgtgctgtttatcaacagatttcttcaggaaattatccacttcccatgtcccgtcttcgtttacatcgagatatgcctcaagtgtgtcggtcgttgccttcgtcagccctgaattggattccgcatcgctaaaacgagcgtctaaatagaaaaacgacgcaacaagcataaccgtaagcagcaggatcacaatcagcatctggccgaaaaagtgaaacaaaaacttccatcttaacctcatgaccgcttgccttcaggatttgggataaaacgatagccgagacctcgaacggttacaatatattccggattgctcggatcgcgctcaatcttctccctaagcttgcgaatatgaaccatgacggtgttgttgtcaccgtaggaaggatagccccatactttttcatatatttgatctttggaaagcaccacgttagggtgttcacaaaaatactgcaaaagctgcagaagctgggctgaacaggcaacggcttccccgcctacgataagctcggcattttgcggagaaaaagtaaaataatcatatgtgtaggtttgatttgaacttgtttcttttgattgatatgtacgcttgagatgtgctctgatccgcgccgctaattccaggggattaaatggttttgtgatatagtcatcagctccaaccgcaaagcccgataatttgtccgcgtcggatgatcttgccgtcaggaaaaaaatcggagcgtctgaatactctctgatcagtgtgcaggcttcaaaaccggacattccgcccatcatgacatccagcacaatcaagtcaaccttattggccttcacaacgggaatcgcttcttctgcgcttgccgcatccagtatatttcgataaccttctttttcgagaacgcgtttgatcatgtccacaatcgctttctcatcgtctacgattaaaattgatgcattttccacttttatgttcctttctgtcactgtttttttcatcttatcattatatcgtttatttatggtacatttttgaatacattggagcttggcaaatcaaaacagcaaaaaaggagcaaacaagcgctcccttttgatgttttttatatgaaaatattatgagttctcatctaccatgtacaaaataaactcccaaaatcccgggacatcctgacacaaaagcatatcagccttttcaaacattttgatcttcagctcttgctctaaatcttctctttcttgataggacgtattgctgagtttttttctgatcatcggtgaaaagcatgcaatcagatgctcaatgtcataagtctcgtctttttgtttctttttttgttcaaactggccgttcacagcttacttttcccctttttttgcgccgctagctgctttctgatattctccagcccctttttatgaatgttggaaatgttttgtcgggactcccctaatgaatctgcaatctcctgcatcgtggcaccgtgaagatacactttcgtcagcacacttttttgtttgtcagtcagcttctgaatcgcttggtagagctggtaatcctgaacatgctggctcaaatcatcctgcctgtctaaaaattcttcaaatgcatcgcttcctgtttcggaaggaagccgatctcctgcctccggatgatcaaccgtcagcggataccgtttttgatttttgcgaacccgcttatcaaaatcaatagaaaagatgcgaatcattgaattcatatacttgacgatgcggatttctttataaaactgcttaaatagctcgtccaatgattttgcatctttttcgttagggctttccattacgtttttgaacaaacggtaatgctgaggattgctcaaaaaatgcttcacgatgggatgcttcattatctccttacattttgaccgtaaaagactttgatagtccatcaaaccgcctccctactaaattaaatgaaggaaagcaaaaaaaagtaaactactactttccgactagtgtcttccaaaatactttgcagcagtttacgttttatcggttttccttcacttacatacatgactgcagaaaaagaagggaggtattttcctatggatcaggtttttatagaggaagtcgtaaaacagatcggcaatttggggtttcccgcgctgattgcaatgtatctgctgacccgattcgaaaagaagtttgatcaactaatagaactaatgacagaactgaaagatcatgcaaaaaaataatttttcaatcgaagttgacttttcactggtttttttcacttaacaaaacagaagggaaaacgaaaggcctttcaccttctctttctgctatcacattaaatttaaggaggaaatatttcatgaaaaaacaaaatgacattccgcagccaattagaggagacaaaggagcaacggtaaaaatcccgcgcaatattgaaagagaccggcaaaaccctgatatgctcgttccgcctgaaaccgatcatggcaccgtcagcaatatgaagttttcgttctctgatactcataaccgattagaaaaaggcggatatgcccgtgaagtgacagtacgtgaattgccgatttcagaaaaccttgcatccgtaaatatgcggctgaagccaggtgcgattcgcgagcttcactggcataaagaagctgaatgggcttatatgatttacggaagtgcaagagtcacaattgtagatgaaaaagggcgcagctttattgacgatgtaggtgaaggagacctttggtacttcccgtcaggcctgccgcactccatccaagcgctggatgagggagctgagttcctgctcgtgtttgacgatggatcattctctgaaaacagcacgttccagctgacagattggcttgcccacactccaaaagaagtcattgctgcgaacttcggcgtgacaaaagaagagattgccaatttacctgacaaagaaaaatatatatttgaaaaccaacttcctggcagtttaaaagatgatattgtggaagggccgaatggcgaagtgccttatccatttacttaccgccttcttgaacaagagccgatcgaatctgagggaggaaaagtatacattgcagattcgacaaacttcaaagtgtctaaaaccatcgcatcagcgctcgtaacagtagaacccggcgccatgagagaactgcactggcatccgaatacccacgaatggcaatactacatctccggtaaagctagaatgaccgtttttgcatctgacggccatgccagaacgtttaattaccaagccggtgatgtcgggtatgtaccatttgcaatgggtcattacgttgaaaacatcggggatgaaccgcttgtctttttagaaatcttcaaagacgaccattatgctgatgtatctttaaaccaatggcttgccatgcttcctgaaacatttgttcaagcgcaccttgacttgggcaaagactttactgatgtgctttcaaaagaaaagcacccagtagtgaaaaagaaatgcagtaaataaaagacttgcggcttgcagagagcactcgttctccgcaagccttcataaggagctgaaccagtgaaacatcaaaacccttcaaaacgcttattgcggctctccataaagtacttgctagccgcagcagcagtggtgttgacctattttgctgtcatctatatattgttttctttagcgggaacgagctaccgctcagcagctcatgtcctgctttttgccgtggtatttcttgttctcggattatgctttgaaccatttgaaaggctgatgatacatagctttacatttttcaagacgggaaaacgtctattcattctccttgccggcatcgtacagctgctgtttttgtggatgactgctcatacaacagaccaattgatcagcgacatctggctgtccaccacagaagaaatgattgtcgcagccgtttttttgattttagacaaatgcaactcggctcttcccagctaaaaaaagaacgcattccaattggatgcgttctttttattcatagcgaagcgcgtctacaggctgaagcttcgaagccttaatggacggaagcaagccaaagataatgccgactgccattgaaaagatgagtgctccgacaacagctggaatggagacgataaaaggcatcggaaaaatgaccgtcagcagcttggcgatgccgaagcccgccagcacaccgagtattccgccaatgcttgtcagcacgacagcctcggttaaaaattgaaataaaatcacacgccgcttagcaccgagcgctttcttaattccgatttccctcgtgcgctccgttacggaaacgagcataatgttcatgacgccgataccgcccaccaaaagtgaaatactggcgattccgccaagcagcaatgcaaatgactgattaaaggactccacttcctgcgcgatctcctgaagatccattacactgtactctgctttttccagctcagcttctgacagtccctgatttaaaagatctgcagccattacacccgcttcttggatatgctcagaagaatcagcctgcacggcaatctgcgttggcgcgtcaaacccttcaataagcggccacacttttttcggcacgtacaaaaccgggttcgcatagtcgccttcaaacatgctttcctgttgatttttttctttaaaaacaccgacgaccttaaacggcacaccattcatctcaatgcttttatgcagagcttctccgtccggaaacagttcatctctgacagcttcattaatcatcaccacttggtgtgtgctgtttaaatcattttccgtcagctttctcccttcggttattcggattggaaacatgtcgaagtaatcatcgtccactccatacacttggggatacgaaacgttagttaaatgaaaaacgctcgcgccttctgataagtaatataaggataatcctttgaccatcggatctgatttgatcgcctttactgtttcttccgctacaggcggcgcagacgcatacgacacctgagggccgccgctctcctcttctccgccagacggctggtagacaacgttgatcgcgttgtttcccatgccgatcatactttgctttaattgctcactttggcccttcagcattgaaacaatcgcgatgattgccgctatgccgataatcacgccgagcattgtcagaatggatcttaatttatgagagaaaatggattgaatggagattcgaatatgttcaagcatggctgatatcccctctctcatctaataccaactctccgtctctgataaaaacggttctgtcagcttttttggcgacgtccgggtcgtgggttatcataataatggtcttgccttcccgatgcagttcagaaaacagtgacaaaatttgttcacttgatttggtatcaagcgccccggtcggttcatcagctaaaataaacctcggctgattgacgagggccctcgctatcgccacccgctgcttttggccgccggacagcttaggcggtttgtaggagatcctgtcttttaatccgaccttttccagcgcttcatatgcccgttgccttctctcttttttcttcactttattgtagatcatcggcagctcgacattttgcagcgcggtgagacgcggcagcaaatggaaagtttgaaacacaaacccgattgattcattgcgaatttcggctaaagccccgtctttccctttcaatatatcgatctggtcaagcgtataggttcctgaggttggcctgtccaaacagccgataatattcattaacgttgactttccagaacccgaaggccccataatagctaaaaactcccccgcctgaacagtcagattgatatgtttcaagattggaacttcttcttttcccagcttgtacgactttgaaatattattcagtgtcagcattgactgtaacctgctttccttccttgaccgcgggatcaggatagatcacataatcttccggcgtcaggccgctcttaatttccaccatgtcattttcatcagtctctccgatttcaacaggctgcttaaccgctttctgattctcatcagctttccacacatacggttcgccgtcatcctgaatgaccatgtcggacggcagcttgatcgtgtccgcatcagcattatcactcatcacttcgatgttgacatgatagccgacttcaagacctttatggctgtctaataaaatggtgaaaggatagttagaggactggggattcatttcttcatcagcaaagctttctgattcttcaccctcgcctgctcccgctggaagcttgccgatcgaggtgacctttcctttccactcgccctcaccgcctgttttcagcgtgaccctgactttgctgccttttttgatcgtgtccattaacagctcattgatttggcttttgaccagatatttgcccgtcgaaacaatctggatatacgggcccgttgcctggtcgcctgttgcaccgtcagcgatatcctgattgacgctttgaacgattccgtcatgcttgcttgtaatgacattggaacctttgtttttcgtcaggccagccagttctttttgatgctgcttcagttcaagctggcttgttttcaaatcgaaattggcctgatcaagttcatcttgaagctgggttttctcttcttttcctgccgctttcagcttcttttccgtttccgttattgatttttgcaaacggttgatttgcagatttgtcatttcaatttgcaaattggcttgctccacttcatcagaatgatcctcgccctcatactcaaaaagcttatcgccctttttaacctgatcgccttctttgacgtatgtttttttaatgctgcctttttctgaatctatgtatactttctgctgtttctcaggttcaacctttccagaaaacgtttggcctgattctgaatctcctcccatgtataccgcgaccgattcagcatagggctccgatgatacggcaacttggttcatgtgggtaaaaaagtaaaaaccgccagcgccgatcccagccaatacaagcacaccggcacatatcgcaccgccaataagccattttttcttcttggacacaacgatctcctctttctgtaaactatgtaatattttcgaaacattctaaccaatattatctattaattcaaaaagacttgcaatccttttattgaaatgacggaatcaaatagaaaaattgtattttcaaagccgaataaaaaaaaatcccggcttcaaaccgggattttttcatacagtaactagctctttttcatttttaatcaagtcatatgtcaagcatacaggtttatttgtacggggatcagtcacgatttcggcatcaatctgaaatacctgcttcaaaatgtccggtgtcatgacctccagtgcagttccttccttgatgaccgtgccttttttgagcgcgatcatataatgagaaaaacgagctgcatggttaagatcatgaatgaccattaaaatcgtccgcccttgctctttgttgagtctgtcaagcagctgcagaatttcaagctgatgtgcaagatcaagatacgttgtaggttcatccagcagaagcagttccgtcccttgcgcaagcgccatggcaatccacacgcgttgacgctgtccgcctgacaatgcctcaatcggccgttcagcatattcagccatgcctgtttcttcaagcgcccatttgataatccggcggtcttcgtcatttaatctgccgaatcctgattgatgtggaaacctgccgtacgacaccaattcgtgcactgttaggccgctcggcgcttcaggtgtctgtggaagaatcgccatatcttttgcaatgtcctttgtagacattttatgaatcgctttgccgtttaaatagacggcacctgcatgtgaacgcataattctggacattgtttttaaaatcgttgatttcccgcagccgttcgggccaattaaggtggtaattttccctttaggaatcgatatatttaaatcttctacaatcaccccgtcgccataaccgattccaagctgttccgttgataatgaattcatattcggccccctcctctaattcgctttcatcaataaataaataaaataaggcgcacctagcacggaaatgacaagtccgaccggaatttctgatggtgccaatacatttctcgccagcgtatcagcaagcaaaaacaggaatgagccgatgaaggcggagaccggtatcagcgtctggtgacgtggaccggtcagccttctagccacatgcggcgcgatcaatccgagaaacgcaatgccccccgcagctgccacgcatgaagcggcaagagtgaccgctgccagaagaagaatccgtctttccttttcaacagcggtgcccagcccggtcgccaattggtctccgagctgcataatgttcaaatagcgtgccttatataaagtaaacagaagcaagatcacaatccaagggagaatcgcccagatcatattccagttcgccccaatattgagccggatatccaaaccgcggcttgcataaaatcatgagggtccatcttaagctgaaaaatcagcaacagggcgttgaatccggcattcacccctatgccgactaaaatcagccgaatcggtgtcacgccttttttccatgccagaatataaatgagaaacgcagcgaggattgctcctgccaaagcactgaacggcagcataaatgttccgaaaaagctgagatctgaagctgacccttgaaaaaagtatataaaaagcactacagcaagtgaaccgccggcgttaattccgagaataccaggctcggcaagttcattttgagacacgctttgcaaaatggctccagctacggagatccctgctccaacaagcaaagaaaggatgatcctgggcagcctgaactcaaataagacaagttcatcacgcgccgttccttggccgaaaaagacctgaagcgttttaagcggtgcaattttgataacgcccaaattgagactgataaaaaagaccaccacgataagcaaaaaggtcacagccattacaacgagcggtttgtttgtttttgttttcattacagccctctcctttcacgacgtgccaaataaaagaaaaagggaacgccgataagagaagtcagcgcgccgacaggcgtttcaaagggcgcatttacgagtctggccgctatgtcagcaaaaacaagcaaaacagcaccgagcaccgccgagcaaggaatgatccaccgataatccacaccgaccaaaaaacgggtaatatgcggaatgatcagcccgataaatgcaatggtgccggcaatggaaaccgcagctccggtcagaattactacaataagcatgccaaccagtttcaccgctgatgtatattgtccaagcccttttgccagatcgtcaccgagacttaacactgtaacagaccgggcgatgaaaaacgcgagcgttaaaccgacagcccctgcaataagcaaaagctggacccccgaccatttcacacccgctaccccgcctgcgtaccaaaagctgatatcctgagcgacatcaaagcggattgcaatggcagttgaaatgccggtaaagaaataagtaactgccgtacccgccagagcaagctttacaggcgtaagtccgccccttgaaaacatgccgatgcccattaccgtcgatgcccccagccccgctcccgcaaaggaccatagcacaagccccattgcagaaagcccgggaaaaaaggcaaacgcaatcgaaacagcaaacgcagagcctgatgtcacacccataatcgaaggctctgccaaagggtttctcgtcatcccctgcatgattgctcccgacactgccaacaatgcgcctacaagcgcggcagccgccgttctcggcagccgaagatcatgtataatttggtgagatgtctttgtcggctgataatgaaaaatggcgtcccatacagtgcgcaaatgaatatccgctgcaccgagagatatggataaaaatgcgccaaggcaaagcaggcatagacctgcaataaggacgatgaccgcgccatatgtccttgacgtccattggatttcttctgatgcagtctgtatatttttatgttgactcaactgccgtacttcctttctgttactgataatgattatcaattgctgtttcagtatatcacttttttcagctgatttaatagagtgttttgaacaaaaatgaaaatgcatttgcaaaaatatcgtgtcaaccggcacttgcagtggtataatcacagatgataatgattctctttttcatttatttttttagaaagaaggtatgagatatgacccatatatacaagaaactcggagccgcgttttttgccctgttattgattgcagcgctggcagcctgcgggaataactcagaaagcaaaggttctgcctctgattcaaaaggcgcagaaacctttacatacaaggctgaaaacggaaatgtaaaaatcccgaagcatcctaaacgggtggttgtcatggcagacggctattacggctacttcaaaacactcggcatcaacgttgtcggtgcgcctgagaatgtatttaaaaacccttactacaaaggaaaaactgacggcgtcgaaaacatcggagacggcacttcggttgaaaaggtcattgatttgaaccctgacctgattatcgtctggacaacacagggcgctgatattaaaaagcttgaaaaaattgcgccgactgtcgcagtaaaatacgataagctcgacaacatcgaacagctgaaagaatttgcaaaaatgacgggaactgaagataaagctgaaaaatggctggccgagtgggataaaaaagttgcggccgctaaaacaaaaatcaaaaaagcggttggtgacaaaaccatttccattatgcaaacgaacggaaaagacatttacgtatttggtaaagactttggaagaggcggaagcatcatttacaaagacctcggcctgcaggctacaaagctgacaaaagaaaaagccattgaccaggggccaggttatacaagtatttcattagagaagctccctgatttcgccggagattacattttcgcgggcccatggcaatcaagcggtgatgatggcggcgtatttgacagctccatttggaagaacctgaatgccgttaaaaatggccatgtatacaagattgatccgattggcttctatttcacagacccgatttcattagaaggacaactggagtatattacggaaagcttgactaaataaacaaaagagccgcctgtccgcggctcttttgtttatttataaggaacggctcaatttgaatcatatcggatattttctttgagccattcatattaagctgcatcctcaacacgatcagtttttttatgctggagagactgaaaaacgttttttgcatattcgattgtgccttaaggtttttctttcgatttcagctttcctgtcagctaggttaacgaacggattcctaacaggagaaattgtgattttataaaaaagacacctgagcaaatcaggtgtcttttcattatgcttgtttttctttctggaactttttactcacaaatggataaacgatcaagccgacaaagaataaaccgatgccgaggataaatgtcgttaaatctgctgtgcctgttacgataacaaacacggagtatgcacacgccagtatcgcgatcaatccgtctcttacacgggagcctttcagctggtcatacgtttcacctttgatgactaccttcaagctgtagattgcagataccagatacggaattaaatatgcgagtgtagccgctgtcgttaaaaatgtaaatgcgtcacttattgtccgggaaataaccgagaaaatgaagacctgtgacatgacgtttgtaataatgagtgcaatgaccggacttccctttttattcgtttttgcaaaaaatgccgggaaatctcctgctttagcggcttggtatggcacctcagagccaagcaaaatccagccgagcatcgttccgaataaacaaaggatagccaaaagcgccataatcacgcttcccgcgtttccaacaatcgcatagagtacatcaacaaatggtttttcagagccgacaagcttatcatgcggcagaacacccatcgtaattaaagtcacaataatatatatgctcaaggcaatcagcaagccggtaattgtcgcacgtttcacatcacgctgagagcgcgcacggccggacaggatcaccgcggattcaattccgacaaacgcccacagtgtagaaatcgcggcgttatgaacctggccgccaattccaatgcttgtgccgttttctccttgaaccgggaaataaaaatgaccgaataatgtcgtttgaaacacaaacaaaccggcaacgataaagaagacaaaacctaatactttagaaagcgttgtgacaaagtttaatttacttgcgccgttaatgctggcaacaagaatcgcgtgcgttccccataacaagatcgtacatacggcaaacgtcagtaattggccgagtgtcacctcttgcccgccgatcgaaaacatctcacgtttatcaaccaagatcgggaagaacgaagtcaagtaaccggcgagacttgtgatgatcgccacgttgctgatccagctcgccacccagtagccccacaccattgtgaaaccggcagcgttgccttttttcgggtcagaaaacagcgctcttgcataactttgcggtcccgctgtcagttcaggcttgcgaatggacaagtgtccgaacacaagtgcaatcatcagcacgccggcacctgtcaaaagccaggcggacgtagctccaaacggactcgcaattgaagcaagcgagctcggcaaggagaaaattcctgatccaaccatatttccaacgacaaacgccgttaataaccaaaaaccccatttttttgtctgttccattccagtacctccatgattctttgtacggaccagaccccgagatcatataaacgcaaaaaaagcctgaacaaaagtccatgcttaaagaaacacacacccttgatctccggatagccctccgcgaaaaagcacgcggcagtcctgcacttattcagatacagtcccagcatagagaaggatcggctttctccacacttcggcgctgatgccttttacacatgtttaacagcccctgtcagcctggcatgtgtgacttatcatccgcgcaacctctacctcactgagaaagagtgaggatttaattattcagttactcccagaaggttatcaaagaaaggatgatctgtcaaagggaacagatggaaaatacggatagggccaagccctatccgcatgtgattatcgattatttttctttttttgcacagcttcttgaagcggatcatcttttagagctgaaccagcatcttcaagagctccttggattacgtttttttctttttcggaacgttttcctttatctttattaaagaaacccattcgtatcacctcttttaaaaaataggtacatgtttaagatgcctcttttatgaaaaattatgcgggatattttttatcgtccaaagtcctgttgatcaaacttacattctcttgatatatttgtaattcagagattttttgcaaaagataaaaggagaagcggcaaatgacaggaaaaacacacatcatgggaggcatcgcttcttgtacggcagcggcttattattatggatttgatccagtgcttatggctgcgtcaggcgcggttggagcattaatacccgatatctgccacacacaaagcaaaatcgggagaaaatttcctattttatcgaaagtggtcagctccgtttttggccatcgtacatttacacacagcttgctgtttatgctcatcatgttttttatcacttctacatacattccagataaaaacatatcagccggcctgatgatcggaatggcaagccacttgattcttgacgcttggacggtgaacggaatcaaattattattcccttcaacgatccgcgttcggcttccattatatatgaagacaggcagtttttctgagcagctcgtgctagctggcctgacccttgcttcatgttactacttttatatgctgtttcatgggcgcatgttttaaacatgagtgctgagacttgtctgaaccggctgtttttagtaggttttacttaagaagcatttcatgcagatgatcaagaaaacgcgaggagtcatattgatgaaaggaaccttttttcacaatcagcggtttttatgtttttcgatcttatttatgtggatcaaaacgtatgtgatatataaactcggctttgatttgcaaatcgatactctgttggaggagctaatgctgctggtcaacccgctcagctttattcttcctttattcgggatcggcctgtttctaaaagaaaacaagcagcgggcctttttgctgattgccaatttggttctgactgtcatcttgatctctaatacgattttttacggcttttatatcgattttattaccatcccggttttatttcaggccagcaacatgagcgatatgggcagcagtgtaaaagaactgttccatcctctgtttatcgccctgtttgtggatttggtttttctgctgctgttcgccagaaaaaccaaacacccacagacaaaagccgctccccgcacgatcaaacggtactatgcagcttcctgcggcatgcttttatgcacactggcacttgcagaagtacagcagccgaagcttttggcacattcttttgaccgggaaatgctagtcaaaagcatcggtctgtttcagttccatatttacgatacaatttctcagactgttaatatcagcgcgaaagcttttgccgatgaagacagtataactgccattaaaaactacacagaggctgattacagcaagcctgatcaaagcaaattcggccttgcaaaggggcgcaatgtcatctttgtaacacttgagtcgacccaaagctttgttctgaatgaaaaagtaaatggaaaagaaattacaccatttatgaatgatctcattaaaaaaagctattcctttgatcatttctatcagcaaacagaacaaggcaaaacatcagattcagaatttatcgtcgctaattcactgtatccttcccttagcggcgccgtctttttcacgaaaagcgaccatcaatttcatacaatgtataaatcgttgaaacagcacgattattattcagccgtctttcacgctaaccataaaacattttggaacagagatgtcatgtacgatacatttggcattgaccgcttttatgatgttgatgattttcacgtcactcccgggacatcgacaaactggggcttaaaagacaaagaatttttagagcagtccgccgaaaagctgaaaagcctgccgcagccgttctacagcagttttatcacgttaacgaatcattttccgtttgagattgatgaaaaggatcagctgatagatgaattcgattcaagcagtgatctgttaaaccgctatgtgaccacggttcgctatgaggatgaagcattgaagcattttatcaaaaaactgaaggacgaaggcttatacgaaaattcgatgatcgtatttatgggagatcattacggcatttctgaagcccataacgaggcaatggctgagtttttagggaaagacgaaatcacaccgtatgacaacgttcagctccagcgggtgccgtttatcatacatatcccgggaatcaccgatcaacagccggaaaccatctctgatgttggcgggcaagtcgacgtcagaccgacactgatgcatttactcggcgttgagacaaaaggcgatatccaattcggcaatgatttgctgtccagcgaccgcaccccattcgccgttctgcgaaacggcagctttattacgaacgattatatatacacaaagaacacgtgctatagccaaaaaacaggtgaagtgctggaaaatcaggatgcgtgcctcccttataaggagaaagcaaacgaagaactgtctctctctgataaaattttaaatggtgacctgctcaggttttccgaatgaaaaaaatccctctatcaagagggattttttacgtttccaatatcaccttgccagtcagctttgtttcatagccgtttaaatgagacaaattcgccttgtattcctcagaattcaaaatctccttcacggccttcagcagctgctcatgttttttcaaaacgacgatatcatattgttcgtcgatgagcgggataaaatcaacactgcccatatgtgccgcgtgctgtgccccgattcccgcgtcagcctgtccgcttgaaacttgtgaagcagcagcgtaatgatcagtcacgatatcgctatatcccactacatcagctggattcataccaagcaagccaagctgttcatcaaggagcacccttgcgccagaacccttttccctgttgatgatccggatatcggttctttccaagtccttccagccttgaatatttttcggattcccttttttcacatacagtcctgctttgcggagaacgacattgaggagacaaaacggttcacctgtcaaaatccgttttacataaggagcgttatactggcccgtttcagcatcgtacaaatggaggctgacaatgtcacacttgccttgatacatatcaatcaggctgtttaagcttcctttgtatttacggagcggcgtctcctgaatggcattctccaaatgcttgctgagaagatccatcgaaatgtcctgtccgctgatcatgacattccgtctgtcgtccggctcagcctcctgcacctgtttcggcgcttctgttgcagcgatgggctgagacattctcatattcgttttatattgctttaaatcttcttcatccacacgcatctgccttccgacacgataagcaggcagcacgccttttttaatcaaatcataaacggtcagctttgataccttcagcagacctgcaacttcttctatcgtataggaagaggtttcattcatcatcatcactctcctattttattataccttttcgtccaatgtaaaaaaacccacataaaccaaacataatcagttataattagttatatctaatgataaggggtgcaatcatgtttaagaagtattctattttcatcgcagccttaactgcttttctccttgcagcgggctgttcttcaaaccagtcttcaacggacagcgagaaaaaagtaacgttaaccatctcagctgccgccagcgcgcaggatgcacttgaggaaatccaaaaaaattatgaaaaagagcatcaaaatattaccatccaagataactatggctcatccggcgccttgcaaaaacagatttctcaaggagcaggagcagatctgttcttctcagctgctgaggataaatttaaaaagctggtggatgatggagatatcgcaaaaaaagacagcactgatttagtcggtaatgaaattgtgctggtcgtaccgaaaaacggagattcacctgtgacaagcttcagcaatctggctgaatcagaaaaaatcgcccttggcactccggaatccgtaccggcaggagcttatgggaaagaatcactgacaaagctgtctttatgggacaaagtgaaggataaaattgtgtatggaaaagacgttcgccaagttctttcttatgttgaaaccggcaatgtagacgcaggtattgtttataaaacagatgccctggtctcgaaaaaggtcaacattattgacgaggcaaaagcagatacacacagcccaattgtctatccgttaggaatcgtaaaagatacaaaacaccgtaaggaagcgaaggaattttacgaatacctgcaatctgatgaagcaatgaaagtatttgagaaatatggctttactgcctagtagcataagcgcttcagaatttttcacacccgttgcgctttcctttcaggtggcggcagttgccggaattgttgtcattattctcggaacacttgctggagcatggatgtcacgggcatcatttttcggaaaaacggcactcgaaacatgttttatgcttccgctcgttcttccgcctactgttgtcggttttattttgatcgtcattttcggaaagcacagcttcatcggacaagccatcgagtggattttccagcagcctgtcattttcacctggtgggccgctgtgatcgcctcggctgttgtagcctttccgcttatgtatcaatcagccaaaaccggatttgctgacattgatcccgatatacaaggtgcggcaatggtagacggcgctagcagatggaaagtgtttatccatatctccgtcccgcttgcctatccttcgttactgaccggaagcatcctcagccttgcgcgggcgctcggagaatttggcgcaacactcatgtttgcaggaaacatccccggtgttacgcaaacactgccgacggcgatatatgtcgcattggattccggcaacaatacccttgcttgggcgtgggtcgtctgtattgttgtcatttcctttttgatgctgtttttcattcaacagaaaaaaacgcactaaaaaaactccccataacggggagttttttgattaaaacagaagctcatcaggatttgggccgacacgctcatctttatttaatgcgtcaattttgtccatgtcttcttgagacaattcgaaatcaaaaatatcagcgttttcgatgatacggtgttctttaatggattttggaatggttacaacttcatgctgcagatcccagcgcaaaatcacttgagccacagatttattgtgtttttcagcaatctgtgtcagcacttcgttatccaaaagctgtccctgcatgagcggagaccacgcttccagctgaatgccttgcgctttgcagtaatctcttaattctttttgcgtcaaacgagggtgaaattcaacttggttcaccatcggtttgatttcagcatctttcaacagctcttctaaatgatgaacttggaagttgctgacgccgatcgcgcgaattttgccatctttgtacagcttttcaagcgcgcgccatgtatctttatatttatctttgccaggccaatggatcaaatataaatctaagtaatcaagctgtaatctttccaggcttttttcaaaggcagcaagcgttgtttcgtagccttgatcttcattccacacttttgatgtgatgaagagctcttctcttgacacaccggattctttaatcccgatgccaacgccttcttcatttttgtagatcgctgctgtatcaatactgcgataaccatttttaattgccgctttcactgattcagtcgcttcattaccattttctactttaaaaacacccagaccgaaccaaggcatttcaactccgttatgtaactttacagtatcttttaaacttgttggcacttgaacatccaccctttcactgaaatgtaagcgtctatattatctcacattcctctcagccgataccaataatacgcttaagaccctctttttgcttcttttttcacagcacaggcaaattcaaacactatttttttcctattttaacaatattgagattacaaatacattgagcagggtatgcgtgtagtgtaaccaaatgaaaacaaaggaggaaacaacttgaaacgtattcgtatcccaatgacacttgctcttggtgccgctttgacaattgcccctttgtcctttgcttccgctgaagaaaatcctgctccgaagatgtcgcagacaactactgctggaacaactgccgctgatgtaggtttaaacgtcaacctggatgtacttggaattgccaaccagatcgctgatgccatcaaatccgcacagaatagggatggctttgtgaaaaacctcatggagtcttccttctacgcgtccggccaaaaatataacgtcatggtctttaatttaagccaggaatatgaagatcatttgaacggtgtgcaattttacggctcagccgtttacgacggcattacgtatggcatttgggtatttgaagacggaacctttacaaacaaaggcgatggcggctggatcaactgggccttcagaggctggttcgaccgggatggcagcactgtcgcatttcatcgcccttaataaaaaaaagctggcgctctaacgccagcttttttgctgcatttattcgccgccttcaagcatggcggcttcgacatcattaatgtattggcgaagctcatgggagatgtcccgggaaatttctctttcctcgaaaagtgtttgaatttcatttctgatcgcctgtacagccttcagcttcacttccagcttctgattttcaaaatgggcgcttgatttcagctcatgatggctgtgctccagcctgaaaattaactgtttatagaatgtaatgacagataaaaacacttctttatgctcttccgtattgtgtttttccagatattctatcgctgcttttgccgttttcactcttgttgcccgtatcaatcccgcttcatttaaaatcgacatctccggctttttatgttcaccgaagaaaatccaatacatcagcctcttgagccttgtttttgataatccgactttaaacgggttcgcatacaaaatttccaactcgttaaatcgttcttgcagcacatttgctgtttcttccgggatgtctccccgctccagcatcttcatcagcgcctcttgctctgccttaaccccttgggcacggactttacgctcgtgctttttgatgcgattagacgatgtatattgctgaaaacgaagatttttcattttctcattgtattcagctatcaccgcaagagaggccgttttgtttgtctcattcatgtcctctttaatcgtttgaagggctgttttgatcaatttgcgtctcgccgtcagcagcttcttgtttcgttcctcgtcctcttcttctttttcagtcagaatcggcagcacaacggtagcaatgacaagcgtgcataaaatgacgccggctgctaaaaagagaatcagatttctttccggaaacggcgtgccgtcctccaggaaatacggaatggaaaaagaacctgcaagcgttactgctccacgcacaccggaaatcgaaattaacagcgtcgaacgaagacccggtttatagatgttctgatctttattaaagaaccatttgccgttccagaagaacagcacccacaggaatctcaggagcattaacgtaaatgtgatgactaggatatagccgatcaccttcatgttgctgatggcagtgtcgttaaagataacagaaataacatcagggatttgcgtgccgagaataacgaagaccaggccgttcaaaataaataaaataatgttccacgtacttgaggagacgatttgcagcttgatcatcgtagattccagacgatcctgttcaaccgcatgggtaataccgccagccacaacagctaaaatgccggaaacgccgatttcttcagctgccaaataaatcacaaacggcgtcagaatttgaatcagcatatgcatcgtgacatcctgcatgccaaggcggcgcagaaataggcgaaaacgaataatcaaaaatgaaatgacaaccccgcacagcaagcctccgagagaaataaagacaaagctgacagccgcttgtgctaatgaaaatgcaccagtcactgccgctgcaatcgcaaacttaaaggccaccagacctgatgcatcattcatcagcccctcaccttccagcaggcgaagaatcccttttggcattttcactcttcctgataatgcgctgacagcgacgacatcagtcggtgaaagaatggccgcaagtccaaaggccgctgccagcggaatagcaggaatcatccagtgaatcgtgtagccgcctacaatcacagtcgcaaatacaaggccgagtgcaagcaataaaatcggagcccttaaattccaaagctctgcccgcggtgtcctctttccatcattaaatagcagaggcgcgataaacagaacaaaaaacaattcggtatttaattcaaaatgaagaccctgtggaaatgaggcggcaagaatcccaagagccacttgaatcagcggcaccggaataaacggaataaaccggttcacgatattagaaatcgcaataatcgttaataatacgagcacaactaaaaatatgtccaaatgcatgacctccttcgtctgttgtgtgtcggcatgatgagccaaaaaatctgtttgtctaaaagcccttgagctagggtggccttgcatccgctatgtggtttcgcaggagttccctccacacttgtcttcttttatagtaccctttttagggtattttttctcatgatatgctcacagtgaacttttttgcagcagagcaaattacagaaaaaagagacaggaagctattccctgtctctcttcttagttttctcaatcatgaaaattcgtaccgtcagttgttgctttaataatgcccgcacggatgacaaagtcaccgaaatgctcgccttcctcgcgttctttcgcatagcgggaaagaaggacgcgcagctcgcttaaaatgtctgcttcaccgatgttttcacgatacattttgcttaaacggcttccgtcaaacgcagcgccaagatacatattatatttgcccggcgcctttccgataaatccgatctcaccgagcgcatgacgtgcgcagccgttcgggcatcctgtcatgcgaatggtgatttcctgatcacgaaggccattttcgtcaataatctcttcaaccttatctaacagggtcggcaaataacgttctgcttcagccattgccaatccgcaggtcggaagagcgacgcatgccatcgagctgcggcgaagcgctgaataatgcttgccgtcagttagtccgtactgttcaattaaagcactgatttcttcttttttatcgcttgaaacgttcgcaatcattaagttctgattggccgtcagccggaactcgcctgtatgaactttggcgatttcccgcaagcccgtcatcagcttataatcatcgtaatccgttatacggccgccttcgacaaacagcgtgaaatgccatttatcctcgatgccttccacccagccatagcggtcgccgttatgatcgaaatgatacggcttcgcttcttccaggctccagccgagacggttttccaattcttcttttacgttttctaaaccgaggcggtcaactgtgtatttgaaccgcgcatttttacggacagaacggttgccgtaatcacgctgaatcgtaatcgttttttcagcaacgtcatacatttgctcaggccggcagaatccgatcaccttggctaattgcggatatgtcgcagtatcgccatgcgtcattcccataccgccgccgattgccacgttaaaaccgatcagcttgccatcctcgacaatcgcaatgaatcccagatcttgtgaaaagacgtcaatatcattagacggcggaacggcaataccgattttaaacttccgcggcagatagagcggtccgtacattggctcgacttcttcctccggcgtgccggcaactctttcctcatcaagccaaatttcatgataggctctcgtccgcggcagcagatcatcacttaattttttagaccactcgtatacctctgagtggatttcagattgataagggtttgatgcacacatgacgttacggtttacgtctccgcaggctgcgatcgtatccaaaagtgctgagtggatcgtctgaatggttttcttcatgttccatttcagaatcccgtgcatttggaacgtttcacgtgtcgtcaattttaatgtgccgttcccgtatttctgggacaggtcatccatgacaagccattgttcaggcgtcgagacgccccctggcatacgcacgcgcagcataaactgatatgcgggctcaagcttctgcttttggcgttcatttcggaggtcccgatcatcctgcaaataactgccgtggtgtttcatcaggcggttatcatcatccggaattccggcactgattcgatcgagcatcacttctttcagcgtgccgcgcaaataatcactttcttttttaatgcgttcaacatcacttggagagccgtccggtgcttttagaattttggtcaccatgttgaaaaactcctttcaagtcaaatcaatatacatcacgctgatagcgtttttgctgctgcatatcggcaagataagcctccgcttcttcgcggctcatattgccttctttttcgataatttcaagtaatgtgtgatggacgtcatgcgccatatgcttttcatctccgcaaatataaacagccgctccttcttgaagccattcaaacaattctgcgctatgttcaagcatgcggtgttgcacatatactttttcttccgtatcacgtgagaacgccacatccatttttgtcagcacaccgtctttgagccaattctgccactctgtctggtaaaggaaatccgtgacaaagtgctgatcgccaaagaacatccatgcccttccttccgctcccgtctcctcacgctcctgcataaaggaacggaaaggtgcgacgcctgtcccagggcccaccatgataatcggtgtttcagggtctttcggaagcttaaagttttgattgtgctgtacataaaccggcagtgtgtcacccggctgcagacgttccgcgcacaaaatcgagcagacgccttttcgttcacggccgtgcgcatcgtagcggactgcgccgattgttaaatgcacttcatccggatttgcggataaactgcttgcaatcgaataaaggcgggcaggcatttttcgcaaaatcgagacaaactcctgcgcagatacactaaatgggccatagtcacggacgagatcaagcaaatcgcgcccttcaatataggcttttacattctcctcatttcccgggctaaaagctctctaagctcatcgttccctgtcagctgggctgcctgttcaagaagcggttttgtgagaacggtaatctcatagtgagaaatcagcgcttctttcagcggacggacatcaccttgcttattaagcgtcacaatttcttccgggtcccaattcatttccttaaggagcagctcgacaagttccggatcgttttccggatagacgccgaggctgtcaccaggctcgtaagtcaggccagatccttcaagagacagctccacatgacgtgtttctttatttgatcctctgccgtttaaatttaaattttctaacacttcagcccgaaacgggtttgttctggaatacgaagactcaccggtttgtgacgcagccgccgacgcaggcgcggcgtttccgcccccagcttcatttaatcctttcaatacaccctcaagccattcggctgccggttcatcatagtcaagatcgcaatcaacgcgcggagaaatccgttttccgccgagttcttctaagcgctgatcaaattctttccctgtctggcagaaaaattcgtacgaactgtcaccaagcgccaaaacggaaaagcgcaggtcttcaagcttaggcgcccgtcttccgtgcagaaattcatgaaacgacagcgcgttatcaggcggctcgccttctccatgcgtactgacgacgattaaaagattggttaccttcttcagctgattcggcttaaaatcgctcatggatgagacggtcacttgaaaaccgctctgttcaagctgcttgccggcattttctgcaagcccctgtgcgtttcccgtctgtgaaccataaagaacggtcacttcttttgaaacggccggtgccggtgcttccgcagacacagctgccgccggcgtacccgcagtttcttggacggaaacagattgagcggataaatatccgctcagccagattttctgggattcggtcaaggtcggcagaaggcggttaaggagctctgcctgctcctgattaaacggactgttcattacctgaagttgcaacgtatccacctcacaaagttataaactgatcgaaaattgcatctaattgaactttaccggaatactaggcttaagtaaaatatatttacatgatgataactattaagaatcctaatgataaaacggctatgcttcatgtaaatagaaaaaagagaaggactcccttctcttcattcagcaatctgatataagtgaggcggcacagcggttacaaacggactggcttcacctgtataaaataccgccagcatgtgcatcgcacgggtgcacgcagtatataaaagcctacggtcgtgctctgtatgatagtgttcttcagatgcatcatagacaagcactgcgtcaaattcaattccctttgctaaatacaccggaatcacgcaaacacccttttggaatggttgattttctttatgaatcaggcgaacatctgtatattcactcatgtgggcgtgtgcctgtatgcattgctgcgctgtcttgcagatgacggctattgtttcgtgcccttttttcttgagccggccaatttcttgcgcgagcttttggcaaaggctctcatgtccttcagttttgacaacgagcggcatttccccgcttctattaaacggctcaatatccgctccatcttgaagcatcgctttggtaaactcgacaatctgccttgttgatctgtatgttctctttaaacgaacatactcagcaggctcatcctcaaagcacgcatccatacgctgatccccgtttatggtatgcgcgtagatggactgattgatatcaccgagcactgtcatgctggcagccggaaaaatgcttctcatgtaagccatctgaaacggtgaatagtcctgggcttcgtcaataaatagatgtttgatcttcgtatttttctttctgccctcaatcagatcctgcatataaagaaacggtgctgcgtcctcatagagcaatttattttctgcaaatgccgatcgggtcagctctcctattgccgccatcttctcatgctgagatttccctccccagccagaaaacaattgcaaatacagctgtgaaacatcaagaaatgcaaggagcctgactgcctgcttgagcggtttgaaagcttttttcacaatgatggcggcaagcagctgctgctctctttgataatcgttaaacgtactctcgctgaaccgtttcctttcttgcagttttttgtacacgtccaagtagtcctctttgtcaagcagctcagcttcatgaacgacccaatcctttcgccgttcctttttctcaagcttgttaagctcactcagcagccacttcgcggtttgctccatccgattcggaatggagtgattttgatccaatgagtaaaaataggattgaatttgctcctttgtgatcagcttttgtccgcggaatatgatatttttaaaaatcatcccttcagaggaaagccgtgtgacgtattcattaatgaattgctgaaaggataaacccgccttccatgtgattcccgcaagccttgttggaaaatcaccttccttagtttcggtcaggcaatattcgagctgatcaaaggggctttcacatttgaacttgcggccaaggcgatgctcgatatattcctgaaacgtcgcctgctccatattctcttctcctaactcaggcaaaacagaggatacatagctgttaaataagaagttgggagaaaacaaaacgatttgtccggcatcaatgacgccgcggtgcctgtataacaaataagcgacacgctgaagcgcagccgatgttttcccgctgccagccgctccctgcacgatcaggaccttgcttttttcattacggataatctgattttgttctttctgaatcgtagacacgatgtttttcatttgggtatcggagtgatggcttaatacctcttgcagcatttcatcaccaatcgtcatatcggtattaaacatcgccttgagagtgccgtttttgatcataaactggcgtttcagcaccatttccccttctatcgtttcaccgggcacctcgtactccgcttttcctggggaataattgtagtacaaacttgatatcggcgccctccagtcataaatcagaaagtgttcctccttctcatccaaacaggaagctaaaccgatataaattcgctctgcctgttcctcgccgttttcaataaaatcaatccggccgaaataaggcgatttttttaattgatgaattcgtttgagctgctgatccatgcgccgatgattctgttcccgatcagacaacagctctgcctgctgcttaatgcttgccatcgtttcaatcgcttcatgggcatcatcaaaattaaccttaacatcttcccaaaagctttttcttaatccgatgatatcatgcttcaacccgcccgcagacgtttccagaaaccgctcttttttttcgagctcctgcagcacctcatctattctcgactgctcttccttccattccttatcctgctgattcatgaacggcacctccagaaaatagttgacaaacatagatgaaatactgtaaaatataattggatacatatattaaatatatgatgaaaactggcaaagacaatttatcttagcacattcacccaataccaatcaaggtttgggttatttatatgcagaaaaaaccgatttcaactcgaaatcggttttttctcttatgatttcacattgatcactgttggacgtgcttttcttaggttgcgaatcttctctttcatcagtatcgattccttattccattcaatcttcgatataatatatctttttcattttaaaaacaccgcagagctttaccgtatttgtctgttcatctaacgtgaagaatgactaaactggctgttattgtcatcttccataaagcaactacatctctgctagcgtatctatagtcgcagtaaaatagtcatttttcatccaatttcgacatatttcaacaaattgaagtttttcatttgggagaataggacgatgttacattatttctctcggtttatgatatgaacatgaagaaagaaccagaattagttaggaggaaatactcagtgaagaaaaagctatctatgatgttgctggcattcgtcgtagccgtaacaagttttacggctattgacctagtaaacaacaaagcggaagctaaagattgggttaaaaaaggtcaaatatggagtactcattaccattcgggctcatttaaaaactatacttactcgccaacttttcatatttattatccaggacaaggaacttgggccaacattacagcaaacggatcaggcagcgggaaaattacagcaactctgcaacaaaagacaaataaaggctggaaaaatgttaaaactttttatgcaacgaaaaaaggctctacaaatttaagttacaaacaagcttctaaaagctacaaaacaaaatacagattcaaattcactaacacaggaactaaaaaaaccatcagctataccttttgggctacctattaatttcaaatagctttgttctgcgcggtttcgaaaaggactttttatttgatcccggcaggctaccataaaagaaacctctccatgacggagaggtttcttttattttactgactatctaagcgaaaagaacggtttggcagcttccaattaaacatataggaacaaacccggcaaacaacgagcacgaaaaacagaacgtataagccgaacgagtttcccagccagcccaagccgacgattaaaccgccgagagccgcccagactgcataaatttctgccttcagcacaagcggtttgcgcccggcaagaaggtcgcggatgattccgcccccgcttcccgtcagcacagcagccacgatcacggcactaagcggatggcccattttgacggcatacagtgcgccttggatagcaaaggcagcgaggccgatcgcatctgataaattgccccacttattccaatgcttcagcagcagcttcggaaacagaaacacaattgtaatagataaaagcgcgatttgaaagtacgctccctgctcccatagcgctgacaccggaacgccgatcagcaaattgcggatcgctcctcctccaaaagctgtgacaatccctaatatataaactcctaaaatatcatattcctcttccatcgcaacaattgcgccgctgactgcaaacgcaatgatgccaatcacactgagcagctcccaagccattctgatgactcccttttatgtttgttaaattttctgacgacctctagattttataatcgctcaagggtaaaatcaataacattttcacgataaaaaagataaattttgagggagtacaccaaacgctattgagcgtgagttttcgagataaaaaaagcgcccggcatacgcgggcgctttttttgttattcagatttttcgcctttcagcaggcacataaaaatgataatcaggataaaagcaatcagggccaggaatggaatcgtaataaaaccaaaccagttaatatattggcccgagcacggcacgccgctgacacatggcttaatgccgctaaaaccgggcactttttgctctaagtaatgcatgatcgaaatgaatgcccctataatcgccatcgggagcacatattttttcactcgtgtgtccccttgaaaggtggcgatgcctaaaatcaggacgagcggatacatgaggatacgctggtaccagcacagttcacatgggataaactttctgatttcactgaaatacaggctgcccagcatagcgataagagccacaacccaggaagcatataaaaatacgattctatttttcatatcgttacttccctttcagctctttttctattgtctctttgatttcatcataatccgcaaaatttttgatcactttatcattgacgtaaatcgtcggtgttgcctgtatgttcattttttgattaaggtcagaatccttttccacttgagaagcgaatgtttccttatcaagattttccttgagcgtctcaggttttatctttgtggtgctttttgcaagatcaccaaggaggcctgaggttacccattcctgtttcgtatccggctgtttttcgaacagcttttcatggaaatcccagaaagagtcagggtcttccttccatacttcttcagatgcaagagccgctaaccttgaaccttttccatggaacatgacgttcacgaaagaaaatttcacatcgcccttatcaataaagtctttttgtatttttggaaagatatcactgttaaacaccttgcaagacggacatttgtaatctccgaattctactacagttaccggtgcatcgtccttgccaagcacaggctgccctttgatagacggctgtccggacaccgcatcattgccttgttccgttttgttattaatgatgacaatggctgctagcaatacaacaaccacaaccgtaaggatgaccgcgaatttcgcagaagactgctgtttctttttcactccgacacctcatcgttttaaaattaaaaaagaagcggatcgcaattgacccacttctttattttaacaagacaagcgctgataagaaaaccccgaaaaaatgaattctctccgacaatttatttgtttttgagacgcatgacgcgcatggcgttcgccacagcaagcagtgtaacgccgacatctgagaaaaccgcttcccacatggtcgcaattccaaatgcaccaagaatgagaaagatcgctttcacacctaaagcaaatccgatgttttgccacacgatacgccgtgtccgtttcgcaatcctaatcgcttccgctatttttgacggctgatctgtcattagcacgatgtctgcggcttctaccgcggcatctgagccaaggcctcccatcgcgatccctatatctgcgcgggcaagcaccggcgtatcattgatgccgtcaccgacaaaaatgagtttttcattaggtgaaagcttagcttccaatgcttcgacctgcgcgactttatcttgcggcagcagctctgcatatacctcaccaatcccaagctgttttccgacggcttctcccgtttgtttcgaatcacccgtcagcatagctgtctgtttgatcccaagcgacttcagatcagcaaccgcctgtgctgcgtcttcctttatctcatccgctatgatgattgctccggcatagcgttgatcaacagcaacgtgtacgattgttccagcattttcatccgggacatcctcaatttgttctctttccatgagctttttattcccggcaaggatctcagttccatttacctttgcaaaaatgccgtggccgggatttcttcgtatgactctatctcatcggaggaaagcattttcccgtaagctttacgcacagattcagcaatcggatgctgtgaatgaagctcagcgtatgccgccgcttcaagtaatctatcctttgtaaaaccttccgcaggtttgatttctgtcacttcaaagctgccttttgttagtgttcccgttttatcaaacaccgcgtatttgacttgattcaaagcttctaaataattgcttccctttacaagcactccggcctttgaggccgctccgattccgccgaagaaaccgagcggaatggagacaacaagcgcacaaggacaagaaatcactaaaaagataagcgcgcggtacacccaatcggaaagcgcggcgccagaaagaacaagcggcggaacaaaggccagcaataccgcgatgatcacaacagcaggtgtataatacttggcaaacttcgtgataaagttttctgtccgggctttacggctgctcgcattctgaaccaagtctaatatttttgatactgctgattcctgatagccctttgtgacttcaatatgcagaacgccgttttgattgataaagcctgacattacatcttgtccttccgcagcttttctcggaacggactcacctgttaaagcagatgtatcaaccatcgctgacccttgcacgaccttaccgtccaagggtatgctttctcccggattaaccacaatgatgtctcctgtctgaacgtcctccggggaaacctgttcgatgccgttctttattttgagattggcgtaatcaggccgtatgtccattaacgcactaattgattttctggaacggctgaccgcggctccttgaaaaagctcaccgatttgataaaacagcataacggcgaccccctcagggtattgctgaatcagaaaagcgccgattgtggcaagagccattaagaaatgctcatcaaacacctgaccgcggatgatgtttttgactgcgcggattataatgtcaccgccgataatcaaataagcaccgaggaaaaggaaaaattcaatggttcccgaatgaaccaaatatgctgctgcgccgagaatgacagccgccgccattctgatcagcatattgaccattctattacgatagccatcatcagctgatttctttatatgcttttggcgaaccgttacatgcggatcaattgatttcacttttttctctactttattcgtgacccattgctcttctttcccatcggctgagacagttaaggtgcttgccgcaaaatttaccgcgcatccgtcaatgccttttatgcctttgactccattttcgattttttgggcacaattgctgcaatccaaaccgtccagaacgtattcctgtttcactagtctcaccttaccttccgatttagggttcccacttcaaagcgtatcaatgagtattgcattctttataatatatatgagcatatactcatataatagttacacctattatatgttgttttccaagaaagtgtcaatgaaaaacaaaaaccggcatatagccggtttttcattttactttttgcagacgaagagcattcagaacaacggaaacggagctgaatgccattgctgctcctgctatccacggtgctaaaaatccaagtgctgcgattgggatgccgaggctgttatagccaagcgcccagaataagttttgtttaatgtttttcattgtcaatctgctcatgcggattgcgtcggcaatgctgtttagatcgccgcgaataagtgtaatgtctgctgtttccatggcaatgtcagttccagttccaatcgccatgccgatgtcagccgtggcaagcgccggcgcatcgttaattccgtcgcctaccattgctgtctggcggccttctttttgcaggcgggcaatttccgccgccttttgttctggaaggacttccgcaatgatattcgcaattcccgcttccttcgcgatggcttctgcggttctgtgattgtctcctgtcatcatgatgacatcaaggcccaactctttcagacgggcaacagccttccgtgacgtgtccttaatcgtatctgcaaccgctactagcccagctgcttctccatcaatggatacaagcataacggtttttccttctgcctctagctcttccattttggcgagaagagtcccatgctcaacctgttcgctctccattaattttcttgtgccgacgagaatgctttttcctccggcttcagccaaaatgcctgcgccgacttttgcttcaaaacgggttagcttcggtatctcaagccctttatctttcacgccagcaataatcgcttcgccaagcggatgctctgatcccgtttcggctgccgctgcaaattgaagcaaatctttttcttcaaaacggccgaatggaatggcatccgtcagacgcggcttcccgtttgtcacggttccggttttatcaagaacaattgtatcgagacgatgtgttttttctaaatgctctccgcctttaaataaaatcccgaattcagcagcgcgtccagatccagccattatgctcgtcggagtagcaagaccgagggcgcaaggacaggcaatgacaagaaccgcaatgaacttgctgatcgcttcggcaaaatcgccaggagccgtccaaagataccaaatgagaaaagtgagaacggcaacccccaatacaatgggcacaaaaatgcctgaaatctggtcagcgagacgctggatcggcgcttttgacccttgtgcttcctcaacaattttgatgatatgagaaagcgcagtatcctttccgacgttgacagctttaattttcaggaaaccgtttgcgttaacggttgaacctgtcacgctgtcaccaggatttttgtcaacaggaagactttctcctgtaatcatcgattcgtcaactgctgagcggccttcaaccacttctccgtcgacaggaattcgttcgccaggtttgacgtaaacaatgtcattaacaagcacttcgtcgatcgggataatttgctcctgtccgtttcttacaacagtcgctgttttcgcttgaagcttcatcagctttttaatcgcatccgaggaacggccttttgcttttgtttcaaacaacttgcctaataaaatcagcgtcagcaaaatcgcgcttgtttcatagtaaaggccgtctgtatgcccatgggagccaaggctttgaaaagtaagataaagactataagcgtaagcagccgtcgtaccgagggcgaccaatacatccatattggcgcttttatttctaagcgccttataagcacccacataaaacggccagccgatcagaaactggactggtgtcgccagcgcaaattgcatccacggattgagaaatatatcgggtacccaaatgaatgatgtaaatgtaaaatggctcaccatcgcccaaagcaatggaaacgacaggacagctgaaaaaatcagtctcgccgtttgcttccgttcttctttctttttagcagcagcagcctcactgtcctgttcacccttcaactttagcttatatccaagcttatctaccgcttctttcaaatcgccgacagacgcttcttttggattgtattcgaccgtaactgtttctaaagcgaagtttactggagcatttgcgacgccttctattttgttaagccgtttttcaatccgattggcgcaagccgcacaggtcatgccctcaatatcgaattcagctttttctgtaacgacgtgatagcccagcttctctattttttcctgaatcgctgcagtccctgtttcagcaggatcgtagattacatttgatgtttccgttgccagattaacatttgcatccgtgacaccgggcatccgcttcaggcctttttcaattctgacagcacatgccgcacaggtcataccagagacctgcatcgcgatttccttttgttcactcaacatactcactcctttatatacacctgggggtatataaaaatgaaagaaatatcgcgcctccctaaaggcgcgataccttgaatcacttggctacatcatagccctgatcttctatcgcatccgcaatatctttgactgatactttgtcagcatcaaacgaaacatcgactttacccgcttccagattgacatgaacggcactgacgccgtccagttctcctacgcttgtttctactgctttgacgcagtgctgacaagacattccttcaacttgcaatgttttttgttccatatcaattcctcctgtttattctttctattttcatcctaccatacccccgtagggtattacaataaaaaaacgctttatgattttgtgaactttttaaatacgtccaaaagctcagaaatggcctgttccccgtctccgcttttgatggcatctgctacacaatgatgggcatgatcctcaagcaaatgaagcgccacatttttcattgccgcctgaacagctgaaatttgcacaagaatatctacacaatatctgtcgttttccaccatgttttgaatgcctctgacctggccctcaatccgcttaagccggtttgtaatctgatccttttctttcgagcttttatggtttaatgttttatgttcgttatgcttttccatgcgtacacctctgtttaatgatattaattcccattatactgattgtccaaacggttgtctaagcatgccgacgcaaaaaatgaatcagttaggttttaccatttgatcaggagggtatatacttctgttgataacgcttttaaaggggagaagaaaagtggatacgatcaaggttggaatattaggatacggattgtccggttctgtttttcacgggccgctgctggatgttctggatgaatatcaaatcagcaaaatcatgacatcacggacagaagaagtgaaacgggattttccagatgctgaggttgtacatgagcttgaagaaatcacaaatgaccctgccattgagcttgtcattgtcaccacccgagcggccttcattacgagcatgctatggcatgcatacaggccggaaaacatgttgtgatggaaaaaccaatgacagcaacggccgaagagggggaaacattaaaaagggctgccgatgaaaaaggcgtattattaagcgtatatcataaccgacgctgggataacgactttttaacgattaaaaagctgatctctgagggatctcttgaagatatcaatacatatcaagtttcctatgaccgctacagacctgaagttcaagcgcggtggcgggaaaaagaaggcattgccactggtacgctgtatgatctcggctcccacatcatagaccaaaccctgcatttgtttgggatgcctaaagccgtgactgcaaacgtgatggcccagcgggaaaatgccgaaacggttgactattttcatttaaccctggattatggcaagcttcaagccattctatacggaggatcaatcgttccggcaaacggacctcgttatcaaatccatggaaaagattccagctttatcaaatatggaattgacggacaggaagacgcactcagagcgggaagaaaaccagaggatgacagctggggtgcggatgatccggagttttacggaaagcttacaaccattcgtggctccggcaaaaaaacagaaacgattccatcagtaaatggctcctaccttacttattaccgtaaaatagcggaaagcatacgagaaggtgctgcgctgccagtcactgctgaggaaggtattgatgtcatccgcatcattgaagccgcgatgaaaagcagtaaagagaaacgaaccattatgctggagcaataaaacaaaagcctccccaaataaggggaggctttttcattagaatgtttttcctgcttctttcgcacgcgcaatcgcgtcttctttgatttgctgtgctttatcaggctccgcattatgtccctctacgaaaatgccatcgaatgatggtacgccgaagaagttcatcatgatgccaatgtagcggtgccccatttccatctcagccgcagggccttctgaatagtagccgccgcgcgcttggatatgaattgcttttttatcagtcaacaagccaatagggccttgttctgtgtatttgaatgattttcctgcaacagcaacagaatcgagatacgctttcatcactggcgggaatgagaagttccataaaggagtaacaaatacgtacttatcagctgatgcaaattgatcgctaagctctcccaaacggcctactttcgctttttcgctttcagaaagctcttcaaagcctgtacctgactgaagctttccccatccgctaaatacatctgcgtcaatgtgcggaatgttttctttgtacaaatcgatatgtacaacttcatcatttggatttgcttctttgtaagattcgataaatgctttacctgttgccatactgtacgaagttgcttcgtcatgcggatgagcagtgatatataatacttttgccatttttaccagccctttcgtttttaaaaatcacacatcaattattatcatacagatgcataatgattattctgtctctcttagactttattatagagacaaagaaatttactttcaagtaaaatatctcgaattaaagattatttaactttcccaaacagcttacttttcaaaagctgttctcaagccggaatacagcgcggacaattctttactgatccgaggataatgaggaacatgcggcacttgaatatccgcaggcatccttttcatgataaaggattgctcagcctgttcaaaaaacgcccgcagctggttgatctcttcatcagaaaacggagcaggcggacggcggtgagcttgcgccgagagcaaatagtaccctaagtgctgagcaccggaaatggcaggccagagcgcctccgcattcgcatgaggaaactctccaagggccttgtcatacgcatcccgaagcctgacaagactcacccttaacttgtgttcgtcggcattctgcccggttaacagtttctccataaactgcccttccagccggatgacgttccccatcagttcaggcagtcgcttcgttgaaaaccgccgccacaaaagtattgtccccaacagcccgatcacgctgccgacagctacatcagtcagcctcgctatcataaaataaccggcgcccgcgccgccatgcatactttctgtgataacaagcgcatttgcggttaaaaagggaacagccagcgcataattgcggacgatcagcatctcaagaagacattgcagcgctgcaatacaaaacgcaatataaacaccgcccggcttaaaaaacaggattgcgcctgccagtataacaccgatcaccgttccggccgaacgctgaatagccctgtgaagcgtaaaaacaacagtagtgccaagcatgaccgctgctgccgaaagcggaatccaataggaacgtgcaaagccgaatgcgagggcaaacatatcggcggcaaacagaacaattccgtactttaacgctctaattaaaactggagacttccagtcaaaagcatttctcaaaaagtaaaaagaggatggcaggcggctcggctccccgtcaagctgcttatcaaaacgttctgaagcgatattcaaaacctcattgatttcttcaaacagcttccgcctaggctcagattcgttctcattaatctgaaacgtaccggaaacccgtgcatgcgcaagcatatctccggtttggcgaagtgccttttcaatctgcgcggtctctctgtccggcgtttcagctgaaaaatgaataatggcaatgaatatgtcgtcagctttttcaaggaggcggaaaaatcgttcatcatgccgcgattttttccgtctgttccctttcccaagaaccgtttggcgggctgttctaagcatgagcacggtctgatgctgtgcgttatgaaaacctggcgttccgacggctgaaagacatgcagccagctgatgatatgttttttgcagcaccgctccctccggtccatgtttgttccataaccagccgattaaagcgatacccatggcgaaaatgccgccgagaaacgtcagtcccgctctgaacagcgcttgtgaaggatcggccggcagcccggaactgactaaaaaggcaaggacaaaaaacatcggcgcagggccttgaatgccgagcgcgctaaaaataaacatcgccgctgcaccgatcagccccaaaacagccgccatcatccaaagcatcccggacaaaagcgtccctaaaccaaatgagagggcgatcccaatagaaaccaagagcagcttcaaggcgcgctttttgtacgattcaccgcccgcatataaataaacaaagcctccgatacttgcaattaatccgtaatccgtgtgacctgccaatgcaccgaccagcacaggaaaccctgaagcgaaacctgatccgatagcctttttccaaggaaatggatttgcatgaatgcgaaaggcatccttcacgataggcatgattctttgattgttcgcagcagttttgttcatttgacaaaatccttttcaatgaatgtgtagaacttttcccgtttcttcgctttagtatgcccaaaaacgcggttagcttctcaattggtgcgcacgataaaaaaacagagacttataccgtctctgcttcattacatcagtttattataaaagcggcacctgtcaggactgttttgtccttctgccttccttcaagagcaggtgaataaaaaataaaggataaatcaatagatacccattaaacagccaccacacaagatcaaagtccctgctgaatgtccagaatgatagcgcctgcagacctgaacaacaggtcagcacaagagaaatcagcgccatcagcttccagtcagcacgattcacccgctgtaagtacaagctgtacaaccctgtgacagaaatcaggatatccagcggaaaaaaagaccagttccaagcgatcataaacggatggtcatgatgtttaaaagcccagctttccggtatgagcgaaaacccggctgacagccagtacaagataaaaccgatatcagtcacgagaaaaaacagcttcatatatctcatttgtactgcccgcttttatgtaccggctcagacaccgcagcatgctcgatcaggtttaaagacacaacaccggcaataatcaaaccaattgaaatgactttcatgacactaacatgttcttgaaaaaacaaaaaaccaatgactgtaatcaggacgattcccatccctgaccatacagcataagcaacagatacatctattgattttagcgtaagcgtcagaaagaaaagactccctccataaaagaaaatcaacagcaaactgggaataagctttgtaaaaccagacgatagcttcatgctgaccgttcccgcaacctcaaacaaaatcgccaagcatagaaacacccaattcacgtggcatcagcctcctcatcagctgttataccgttaaacaaaacatctacaattgattcaagcacctctcctgtcgtgaactgatgtttcagtggatattcagggtcatacacttggttgatgctccctatatacatgtgaacaaacaggtccggattgatgtttctgattctcttttgctgtttgcactcgtttaataatgctaggacaatcgcccattcttccttaataaacgtgtctaatgtaagccacgcatcgtaatggtatttcttgagttcatttaataatcccatgttcagcagttccatcccctgcggaaggctgatcagcatttgtttcaccttttcaagcacatttaaactatcattttcatagatgtctctttccatttgcttcatttcagctataaattgttcgacaaccgcctcaacaagctgatctttagatgaataatatgcatagagcgtccgcttgctcgttcccagcgctgccgccaaatcattcatcgtaaatgaaaatcctttctgcttaatcagccggatggtttccgccatcattcttttttccacattaatcccccgctttcggtaccaagaaaactattttggtaccaatattatacgagagaaatttatggaaatcaacaatatataaaaaaacctctcctattgggagaggtttaaaagacactgcggaccaaaccgccgtccgcccgaagtgccgcgccattgatcgcagaggaaagcggactgcttaaaaatgtaacgaagtgggcgatttcttccggacggatcagtctttgaataatagatgtcggccggttttctttcataaaacgtgcctcagcttcttgaacagtcaggttttcaccaggatacagcgagttcagcatggtttccacaccctctgttaaggtagagcccggcatgacggtgttgactgtgacattcgtgccggttgccagctccgccaaactgcgggaaatggacagctgcatcgtttttgtcgcactgtaatgcgccatttcctgtgacggcataatcgccgcttcactggcaatgaaaatcacacgcccttcctttttctctatcatgttatgcaaatacctgcgtgtcagccttacaccgctcataatattcacttcaaaaaaacgaaaccattcatcgtcgggaatatcaaagtactccgccggttcaaaaatccctaaattgttgaccaaaatatcaacctctggatatgcctgaaacagctcattgcagccttcttctgttcccaaatcaaatgcagccggataaagaaccgcttcagcatgttgtgttttcagttcatctatcgtctgattcactttctcttcccggcgtccgttaatgatcactgccgcaccttcttcagctaacgaagaggcaatagcttttccgatccctgatgtcgaaccggtcaccagtgcggtttttccttgtaaattcagcttcattattcatccctccgtttttgattcctcttatttattgacagaaatctgattggtgaaacatctgctctgcaatcagtatgaaacagctgggattgaaatggaagtacgcactttttggtgcctgtggtttggagaataaataaagcagaacctcttgagaggttctgctttattgtcagtatgtatggagacggtgggagtcgaacccacgtccagaaacatcgattacttaagcgtctacgagcgtagcctgcatatttatggtttcactcatcttcttgcctgcgggcgggccttccgagagctagtctgttcatctcttcttacgttctcagacaggaacgcaagcgtagcctacttggatgtgctcttcacagacacataggcaatgtcaggaagagctcgctgcgcttattaggcagctaatgctacgttttggttaaaactgttagttttgccagttatatttaagtgcgtgtttacgagatcgcctctcggctcgcagctcaagctcgatccatccctgtcgaatccgtaacgtccccttggtataagggaaatacgggagaaaatatcaagctctcactcaaactggctatagtcttattataacatgatcacggctcttttcaattgtcaaatccttcaaatgaatggcgtcgtgatctgatcgtgaacacagtatagcacaggcctgattttcgaatcaagcactatgcctttagaagcctttttgactgtctctgaacgctctttcgatttcccgcttcgcgtccttgcgcttcagatcttcccgtttgtcatagttcttcttcccttttccaaggccgagaagcactttcgcaaagccgttttttaaatacagcttcagcggaacgagagaatagcctttttcctttgttaacccgatcagcttattaatctccttgcggtgcattaacagctttcttgtccggagcggatcgtggttatagcggtttccctgctcatatgggctgacgtgcatattgtggagaaacacttctccccgttcgattttggcgaaggaatctttaaggtttacgcggccggcgcgaatcgatttgatttcggttccttgcaggacgatgcctgtttcataggtttcttctataaaataatcgtggttggctttcttattttgagataatacttttcctgacccttttggcatgccagaacctcctctctctaaggaaaaactgtccaccttttgcgatacgctctattttaccaaatgtcacgtaccgctacaatgaaaagctgtttccgaaagaaagcaaatagagcgctgcggccctatttgctggttgagctgctatttcttctttttccgtttctgtttcggagcattctggaagccgcgttttttctttttcttcttcggcttagtgaaccactcccctttttcctcagacggagctggagaaacaggcgtattggtgctttgaacacgttttctggcaggctttccgcgttttctgctccggctgctgtccaattctctcggacgccgcggagtgcccttcatgccgacgatttcaaagtcgatattgcgctcatctttattgacatcgacaaccttgactgtgatttcatccccgatgcggaagacgttgcctgtccgctcgccaatcattgcgaaatgctgttcgtcaaagcggtagtagtcatctgtcataaagctgacgtggacgagtccttcaattgtattcggcagctcgacgaacatcccgaagtttgtcacagagctgatcatgccgtcaaactcttcaccgattttatcaagcatgtattccgcttttttcaggtcatccgtctcacgctcggcgtcaactgcacggcgctccattgatgatgtatgttcggcgatatccggcaggcgttcagcccacttttcctgtgtcacttcatcgactttgccgttgatcaaatacgttcggatcagacggtgaacgattaagtccgggtaacggcggatcggcgatgtgaaatgcgtatagaattccgttgacagaccgaagtgccccaagctttgcgggtcgtatttcgcctgtttcatcgaacggagcataacagtagatataaccgtttcctctggtctgtcacgcacagcgtccagaatgctttgcagcgcgcgcggatgaatattccccgccgttcctttcaccacatagccaaatgtcgtcacaaactctaaaaacttttgcagcttttcagcattcggctcttcgtgaatccggtatataaacgggacgttcatccaatggaaatgctccgccactgtttcgtttgctacaagcataaattcttcaatcagcttctcggcgacagagcgttctctgatcacaacgtctttaaccgctccttcgtcatcaacaagcacctttgcttctttgaaatcaaagtcaacggcgccgcggtccatccgcttatcgcgcagaatttgagccagacgctccatgtctttgaacatcggaacaagaggctcgtatttttgtttcagctcttcatcatcgtcaacaagaattttattcacatctgaatacgtcattctttccgttgttttgatgacactttggaagatctcgtgctctgtcacctgtccctgactgttaatggtcatttcacaagaaagcgtcaggcggtcaacctttggatttaaggagcagatgccgtttgacaatctgtgcggaatcatcgggatgacacggtcaaccagatacacacttgtccctctttcaagcgcttctttgtcaatcgacgagttttcagttacgtaatggctgacatcagctatgtgaacgccaagcttgtagcttccatcttcaagtttcgtcacggtaactgcatcatccaaatccttcgcatccgcaccatcaatggtgacaatcacctggtcacggagatcacggcggtctttcagatctttttcatcaatagtgtcaggcgtacttgatgcctgttccatcgcgtcagctggaaattctcccggcaggccgtgcttatgaatgaccgataaaatatcaatgcccgggtcgtttttgtggccgagaatggtttcaacctcaccctctgcgttcatgcggccttcaggatagctcgtcagcttgacaacaaccttatgcccttccgtagctccatttttcccatttttcggaatgaagatgtcactcgtgatttttttgtcgtccggaatgacaaagccgaagtttctcgtttctgtatacgtgccgacgacccgctgaatcgctctttctaaaatccgtatgacggttccttcctgcctagagccgcttgattgtgagttcagacgcaccatgacgatatcgccgttcattgccgtatttagctcattaggcggaataaacacatcacttaacgacgtatcctcaggcagcaaaaaggcgaatcctttcgcatgggctgaaatctttccttttattaaattcatcttctccggaatgccgtagcggtcgcttctcgtccgtacgataagccctttttcttccaaggcgactaacgctttgacgagctctttaaactcctcggcttccgtaatatttaacatctcctcaagttcctgaacggtcagaggcttgtacgcctcttccttcataaacgagagaagcttttccataaatgcttctttttccattatccgacctcctgttgattaccaatcgagcttctctaaaaattcatacacatcctgatggacgaggtcacgttctttgtcgagtgtaatgacatgccctgattcctcgtaccatttcagctgtttatcatcagtttccacttcgttgtaaataatattggcgctttcggtattaatcatgtggtcatgacgggcctgcaccacaaatgtcggtgaataaatcatatcgacattattccgcacatcagcaattaagtcttgcagcgccttgagggtattcatcggcgttttttcgaattctttcatttcctcttcaatttgctccgggcttttcccctcaaactttttgtaattgcgagcgtatgaaagaacgccttgatacatgacctcttcactcttaatatgcatcggtgcgcacattgggacaattccctttatgggtacagtgtaacccaatttcagcgaaaaaaccccgccaagcgacagtccgcaggcagcaatgctctcatagccttcagattttaagtattcatagccatccattacgtttttccaccagtcttcgggccccgtatgtacaagttcttcaggcgggacgccatgtccttcatattgaggcgcgtggcacgtatagccgcgttcattcaaatatcgtcccagcatccttacatccgctgtatttcctgtaaagccatgcagcaaaagcaccgctttgtctccgcctttaaatgtaaatggttttggtgtcacaactttcatgctcatgtctccctttctatctgcacgatcattttagttttccacagtttaatcagaaaaaaacgttttgaatatcatccagaaacgtgaaaaaggcctgacttcacatcagaccttatacaaacattgccctataggatataagcaagcgcaatcgttaacacgaaaaacaagactgccagcactaccgtaatgcggtgcaaaattaaatcaagacctcttgctttttgtttcccgaagagctgctccgctccgcctgaaatcgcaccagataatccggcgcttttactggattgaagcaaaacgacaataataagtgcaatgctgacgataaccaataaggtaatcaaaactgcgtgcatcccatacacctccagactcactggctacattacttctattttacatgaaaagggttggcatgtcacgctgtatcagacgccaaaaggccggataagacgttttatcttggttaccctattcataatgaaaaggtcaaaggagaaaagcgatgccgcttatcagcatagacagcaggaaacatcttttttatgaagaatatggacagggaatccctatcatttttatccacccgccgggcatgggacgcaaggttttttattatcagcgccttctatccaagcatttcagggtgatttttcccgatttaagcggccacggtgacagtgatcacatcgatcagccagcatctatttcctattacgcaaacgagatcgcgcaaatcatggacgctttgcacattgataaagctgtgttattcgggtattctgccggaggcttaatcgcgcagcatatcggcttcacccgcccggacaaagtgtcacaccttattctgtccggcgcctaccccgctgttcataacgtaatcggccagaagctgcacaaactgggaatgtatctgcttgaaaaaaaccccggtttgctcatgaaaatcctcgctggcagccacacaaaagacagacagcttcgcagcatattaacagaccatatgaaaaaagcagaccaggcccattggcatcagtattatctggattcgcttggctacaactgcattgaacagctgccccgcctagaaatgccaatgctgtttatgtatggcggcctgcgggactggacctttacaaacgcaggctattaccgaagatcgtgcagacatgccgaatttttcagattggaatatcagggacatcaattgccgacaaaacaatggaaaacgtgcaatgagctggtgacagggtttgtgctgacacatcattcataggaatagaaaacgcttggcttccttgcgttttttgttacttcattgacttttgtcaacaaaatcatagtaaaaaagatcctcaaatttcaaattaaaatagtgaagcattttaccaatcacaagctgccccggccttctttctccattcagcacgcggctcagtgtggcgggtgagactccgatttccagcgcaagctgattaagggaataatcgttattaaccatatactgcaagacataatcacgtctaatctgtatcttttctactggcactttcctcaccttccattcctgaaaaacttttttctatacttttacattacggcttatgttaacttttgtcaatacatttccagtctacctattccctttagtcaataaacatactaaaatatgagtaacagtgagggacggggtgagatatatggaaagctttggcgaacaattacgggcattgcgtgaagagagaaagttaacagtcaaccagctggcgacttattcaggcgtaagcgcggccggcatctccagaatcgaaaacggaaaacggggcgttcccaaacctgccaccatcaaaaaactggcagaggccttaaaaattccttatgaggggcttatgtacaaggctggttacatcgaagaagtgcatgaagccagggccccttatgaaacgaagtgcaagctacttgaaaaagcggaggcctatgatctgaaaaaccttgcgcttcttgagaacgaaaagtggcaatatctcaataaagaagatttgctcatgctggatcattatttttcgtttatttcagacgaagccaaaaaacggtctgctgatgactgactcttgatagaaatgtgaggcgatagaccatgtcaccgttcggacagcaattacgggagctgcgccgcgctcgcaaactgacagtgaatcagcttgcggtgtactcaggcatcagctcggccaccatttcaaaaattgaaaacggcaaacgcgggacgccaaaacccgccacgattaaaaaactggcagccgtcctgaaagtgccgtacgaaaacctaatggccgccgcaggccatattcaggcctttcctgaagaaatccgcgaagcatctgaaagctatcaatccgtttatgaaatttaccagacggctgtcacacgcggagcggagcacctcccgattttcaatagtcaaaaatgggaacatctctcaaagcaggatattgaaaatctcagcaaatacttcgattttttgtcttcagaagcaaaaaaacgcgcctcttcctcataatcccctgtttctctttctatattttatcaatcacgcttgcataccctccctcgttatttgcgttataatagtgacagacgaggtgaaaagtatgaaccaatcagaaatgtgtcctagatttgaaaaagcagtcgacatcttaagtaaacgctgggtcgctttaatcgtatttcagctcttgaacgggtcgcagcgatttagcgaaattgaagcagcacttccaaatctaagcggcagagttctgtcagaacggctgaaagaacttgagcttgaaggagtagtgaagcgggatgtcatccctgaaactccggttcgcatcgaatattcattgactgataaaggaaaggcactagcacccatattaggtgagatttctaaatgggcgactgaatggattgacccttcctttctttcttaattaattactaaaacagctctgatctcagaaacgagaaaaggagctgtttttatttttcgaatgaaaaatgatttctcagctcagaaaattcttatgttattaagtacttggaaaacagaaacggaaaatctgacagacaccggacaggctatgcagcatatcaaacaatccgtcacccacgtgacagaccgcattaaggaagtaacggatggattgaagcagttaacaaaccagtcgattgaaaatatcgcttctgtatctgaaaagtctgcctccggcattgaagaaacattttcgattaccgagcaatccgcccactcgatggatcaagtgcttgaaaatgccgaagagcttgaacagctggtgaaggagcttaatgagaagatggatctgtttaataaaaaaaaccctcgtcgaggttagccgaggagggcaaattatgcactgcgtatatatgtccataataaaggttctaaattgtatactgatttaataactctgctttatatttctcaatatctataacatcgtaacctaaaaacttttcataattatcatcagcaaaacagaataaaatcccattaaattcaaacgaatttgatgtttccaaatcatacaatctaaagctataaatttcttttttgtttcgagcggtttttttgtaaatttttttagaacctgctaatttagatatgtcattagctaattctccgaaaatctccatacctactattaagttttgcttattaatatctaatgaaatattttcattaacttccaaatcctcagtcagctcaactgtagatggttgattaattggaggaattacataaatataagctaactcagcttctttatcatatgttattgccgaatttgaatacatgggataccatcctatctccaacgttttttaggcttcgcagatttataagtagtagttaaagtattaccttttctagcgactgcaacacctttatagtaatatacggttgatttatatttaggatcataatattttttacccttttttactgccataaacacattggtaggtgaaattcctctttgatacattcttaatcctaaatggtaagaaacctttataaatttaaaaccatattttttaaacatagatgaagacattgctattaatactctgacagctgggcctaaccattgaccttctaccttttctgaactttgttgttcatctatttcttgatccatttgatctatgacactagtatctatttcagggttaatttcatctatgtaagcaaacgtttcatcatcaattttgatatctttttcatcgattgtcttttctaaaaacgattcagtatttttgacttctagttcagtaatctctttttcggtatctgcaacatagtttaccacttttttatcatcaatcatatccgaaacgtctagatttagcaattcttcatctgataaagttgtattgttttctaaatcagtaacgtctttaaagctctgatcattgatttgctcagcaaaaaccgtacctgtagcagtaaaaaacataacaaatgctgttaatagaaaaactaactttctactttttttaattacattcttgttcatttcttcctcctaagataatatattgataagcatatattaccacattgaatttttccttcaactattttttggttaattttcataattaaaggagatataaatgttaagacctaatatcacgaattatttattctttttgcttatgataatttttatcaccttattcccatgtaacaacttaaatgcatcttctaatgatatatcacaacaatttaaagatatccaaaaaattaaaaacaagtataagttagatggggaaggggtatctatagcgattttagattcaggaattagcactaaaatgaatttccttcctatagaagaaagcgtatcttttgtaaatgagcctaataccacagttaatgacttaaatggacatggaacttataacaccggtataattaacgccattgctccgaaagcaaaactatacattgttaaagtgttaaataaagaacttaaagggaattatacaaatattacaaaagggattgaatggagtataaaaaatgacgttgatatcatatccatgagtttaggtggagattcttattctaaagaacttcatgccgccataaaaaaagcctataataaaggcataatacttacttcttctgtaggcaataaaggtatatcaaatctagacactgtttcatacccagctaaatttaatgaagttataggggtgggagcattaaactcacatgatgaccgtttattttcttcaagtaaagggcagggaataactataatggcccctggagaaaatttaaaaagttattcaattaatagtgactattataaaacaagcggaacttcagtttctaatgcatatgtaagtggggcactagctcttctatttcaatttgaagattttaatattactaatgaagatattattaacactgtgaaaaaatcagcctactccaaaggatcaagatttgaatatggttacggaatatttgacttagaagaagcaattaaacgtagacataatgctgaattaataaaaatcactttttgtatctttggtatcataactattttcttattgttcctatttttagttaaaaaaattatatctcctaacattaagaagatataattttgtaattctacatatgttttatctttctctagttactatatcaccttcaaggtccgctccagccaagccataagcaaatcagctcctaccgccatcaccgcagtcgggatcgctccggctagaataatggctgttccgtttgtcgcgtttgagccgcggacaatcatgtccccaaggcctccggcaccgacaaatgtgccaatcgctgtaattccgatggcaatgacgagagccgtgcgaaggcccgccataatgacagatagtgcgagcgggagctcaaccattctgagcacttggaatttcgtcatgcccattgctttccccgattctaagtaggcatgctcaatactgataatgcctgtgtacgtgtttcgaataatcggcagcagggaatacagaaataatgatagaatcacggtatttgcgccgagccccataacaagcattaagacggccagcatagcgagcgccgggattgtttgaataacgtttgttacggcaaacacccaggctgacaaacggcgaaaatgcgcgatgaggattccgaccggaaccccgacgacagcggcaaacaatacgccgtaagccgacatgagaaagtggcggctgaattcatccatgacgtaactgccattctgcgcgtaatacgtcattaactgttcaaacacgttcattgacctcgtccccctttcacgattcgaagtagcgatgtttttctaaatattccttggcaacgacagacggttctttgagattgccgtcgacttcatagttaagctcctgcatcgtggctgtgtcgatttttccgagcattttcttgatgatgccttcaagctcaggatgttctttgagcaccttttccggaacaaccggagagcagtcgtacggcgggaaaaattgtttatcatcctttagcattttgagaccataggacttgattcttccatcggttgaatacgcaagcacaatgtccatttttccgcttttcaccgcgtcgtacacaaggccgatctgcatcggatacgtgccgccgaatgtcatgccgtaggttttcgtaaaatcctgatagccgtttcctttgagcttcatccaatagttatcaacgcccagctttaattgcggcgcccattttttaacgtctgatacggtctctaaatggtattggtcggccaactccctgctgactgtaaaggcatatgtattatcaaacccgtaggagtcataccactttaaatcatatctttttttaaactcccgctgagtaagcgccagcgctttgtccgggtctttttccggttgcattctcagcgtgcctgtcagcgcgtctcccgtatatcttgtggccgcaatgtcaatttccccgttcattaaagcctgctgctgcaccgcgttggagccaagatttttaatcgttgttgttttgagatcagtatggtgttcgatcaactggccaagcatgctggcgatgatttctgattcgctcatgctttgcgcgccgattttaatggtctggtctgcagcagcgctgagaccaggaagcgaacagccgctcagcgtcagcgttgccgcaagtgctaaacctatcattaatttgagatattttcttttcatgagccgcctccttatgacaattccttcaatctctgcatgccggcaggtgtcagttttcgttcagcaactgccagcacataatcaatcacaattgccaatatcgtgacaggtaccgcgccccgatgatatattccggctgatataaattcaggccgataaaaatgtaatcacccaatccaccgcctccgataaaggaagcaagcgtggcccagccgattaagtaaatcgtcgatgttctgattcccgccatgatcactggcgcggcaagcggcagctccaccaagcggacttgttcagtcggcgtcattcctatgcctttaccagattcgagcagatttttgttgacgccgcgaatgccggtatacgtgttgcgaagaatcggcaatacggaatagaaaaacaaagccacaatggccggaaccttccctacaccaaggagcgggataaaaaaagcgaggatggccagactcggcagcgtctgaataatattgacaatgccgataatggtgccggctccttttttcattctggtaagcacaactccgagggggacggcaaccagcacgcccaggatcacagcaatgagcgatatcataatatgctcgtatgttttataaagaagctcgcccccattggtttgcaaaaattgaacaatatgatgcatgacttatcgcccctccctatgacaatgctgcgagctgcttttcttctccccagagggagtcatacacgatgtcgaccagacttgccctcgtcacaattccgatcaggcgtcggtcttcatccacaacgggaacatatttgacaccccgttttaaaattttgcgaaccgtgtcgcgcagcagtgtgccgcccagtactgtgtatatattttcatgtaaaacctcacctacgagattggccttttttcggcattgatcaatgatttcaacatcgacatagccttgcagaacgtgctcgtcatcgacgaccagcaatgaatcgacccgttcctgcctcatcagctgaatggcctcagaaagcgttttatccgcggtgatcgttacaggctgtgtgttcataatctggtcaacccgttcaacatccgggctggatgactgaatcagccgctccttgccgataaattcctcaacaaattcgtctgccggatttcttaaaatgtcatcgggcgttccaacttgaacgatttctcccgcttttaaaatcacaatccggtctgccagcttaatcgcttcatccatatcatgggtaacaaatacgatggttttatgtaaggttttttgcagttttttaaattcttcctggagggaatccctcgtaatcgggtcgagtgccccaaacggttcatccattaagataagcggcggctccgcggcaagtgcccgtaatacaccaattcgctgctgctgcccccgcttaattcatgagggtaacggtctaaatattcaggccccatatcgaccaattttaaaagctcacgcgcccgctctttccgctgctgctccggccatttcagcagttttgggacgagtgagatattctgctgaatggtcatatggggaaacaggccgatctgctgaatcacatagccaattttgcgcctgagctctacaggatcctggtccatgatgttttcgccgtcaatgaaaatcttcccggcggaaggctcaattaatcggttaatcattttcattgttgttgtttttccgcagccgctcggcccgataaagcagataaattcgccttttgcaatcttaagatttacgttgttcacggcttttttgccgcccctgtatgttttcgagacattttctaatgtcagcaaacatcgcacctccaaaattaagtttattcaatttgttcagtttaaatttaatttttcagacaattgaatgcttcccattatagaataaagtttataaaataaaaagtttacaatttgttcatattatttataaagtatgtgtaaacgctgatttacccgcattgacgtgtgttgatctccttattgctccaatttcctgccaaattctcttttgacagcattttcgccgtatcaaaaatgtggtatattgacatcggaattgttagctgaaaggatgaaaccgttggagaaagatccgttaacgatcattgaacaagccgaggaccattttatagaaaaaatcgcggaaaacatgcatgcatttggaatgccctctaccgtcggacgtgtgctgggcattatttatatgaatcgaaaaccgatgacgcttacggaattatctgaggccaccggcatgagcaaaacacgcatgagccaggtagtgcgggaaatgcttgatgccaacattgccgagaaggtgttcgaaaaaggcgtccgaaaagatttatatgaggttgagcaggactactatcaaacatttatcacgctgttttcagccacttggagcaaagtcgtcagcaaaaacaaaatgatgcataaaaaactcaatcgggagctgcttagcgtgttggatgaagagcttactcctgaagcggaagaaaaagtgaatgaactgctgaaagaattaaaggaatggcttgattattataattggctcagccgtttgattgagttttttgagagcgaagacatttttaaatatgtgccgaagccgtaaaaaacgccctgtcattacaaggcgttttttcttatgcggcacctgccaagtttttcttctttctctttttaatcgggcttaatgctcgttcaagccagcccatgaccaaatcggcaatcaccgccatcagagctgtggggatcgctcccgctaatataatcgcggttccgtttgtggcatttgatcccctgacgatgatgtccccgagaccgcctgcaccgacaaatgtcccgatggccgtaatgccgatggcaatgacaagcgcggtgcgcaggccggccattatgaccgaaagcgcaagcggaagctcgaccatcctcagcacttgaaattttgtcatccccattgcttttccggattcaagataggcgtgctcaatactgataatccctgtatacgtatttctgataatcggcagaagagaatacagaaataatgacaatatcaccgtattagcgcccagccccatgacaagcatcagcacggcaagcatggcgagagccgggatcgtctgaatgacgttcgtgaccgcaaaaacccatccgcttaatcttctgtatctggctatcaggatgccgagcggaattccaacaatggcggcaaataaaacgccgtataccgacatcagaaaatggcggtaaaactcctgcagcacataaccgccgttttgcgaatagtatgtgccaagctgctgtagtacttccatatgatccacctcttttcttagtcaaaataatgatgtttctctaaaaattcctttgctacgacagacggctccttcagcttgccatccacttcataattaagttcctgcatcgtttccgtgtcgatttgcccaatcagcttattgatcacaccttcaagctccggatgcgccttaagcaccttttccggaatcaccggtgaacagtcatacggcgggaagaaacgcttatcatcttttaagattttcaagtcataggctttaatccgtccatccgttgaataagccagaacggcgtccattttcccgtttttgactgcgtcatagacaagcccgatctgcattggataagttgtgccgaattcaaagccatatgtgctgacaaagcctttatacccgtcaccttttcgtttcagccaagcattgtcgacgcctaatttatattgggaggcattttttttcaggtcggacacggtgttaatatgctcattttccgcaaacttttttgttacggtgaaggcatacgtgttatcaaagccgtaggaatcaaaccatttataagaaaagcgcttttgaaactcgttctgcacaatgttcagcgctttttttggatctttctccgcttccttgccgagggtgcttgttaaatctgttccggaatagcgcgtggctgaaatatcaatgtcaccgcccagcatcgcttggtgctgaacatagtttgagccgaggtttttcactaaagcggtattcaaatctgtatcatgttcaataagctgcgcgatcatattcgctaaaatttctgattctgtcatgctttgcgccccgattttgatcgtgtcgtcagaagcgccgccgagacccggcagagagcagccgcctagcagcatgacaaagacgagagcaaacgcgccaagccatttgatttttgtcgttttcaacagagccaactccttacgaaacttccttcatcccttgtaatcctttcggcgtcacctttcgttctgtcacggctaggacataatcaatgataattgccagaattgtgacaggcacggcaccgccaatgatatattcaggctggtataggttcaggccgataaaaatatagtccccgaggccgcctcccccgataaacgacgcaagtgtcgcccagccaattaggtagatcgttgatgtgcggatccccgccatgatgatgggaattgccagcggaatttcaacgagccgaatctgctcccagccggtcatgccaatccctttcccgattccaggaggtttttatttacacctttaatgccggtatacgtattgcgcaagatcggcagtaccgaatagaaaaataaagcgacaatcgcaggcacttttcctacgccgagaagcggaataaaaaaggctaaaatcgccagactcggcagggtttgcacaatgtttacgaaaccgataaccgcacctgcgccttttttcattctggtaagagcaacgccgagcggcactgcaacgataatgcccaatacaacggctatgagtgaaatatataaatgctctcctgttttatacaacagctctccgccgttcgtttgcaaaaaagtcatcatttgattcatcttaaaagagctcctcccctggtcagatcgtcatgagctggttttcctcgtcgccccaaatggaatcgtacacgatatcaacaaggctcgctcttgtcacaatccctgctaaatggttctgttcatcgaccaccggaacatacttgatcccctgcttcaaaatttttcggactgtatcgcgaagaagcgcccctttttgaacggtatatatatctgaacggtatacgtcgccaacgatgcttgcttttttgcggttttgatcaatcatttccacatcaacatagcccttcagcacgttttgccggtccacaacgagcagcgagtcaacacgtttttctctcatcagctgaatcgcctgagaaagcgttttgtccgcagataccgtcaccggcgttctgttcatcatttgctctacccgctcgatatccggtcttgattgaatcaggcgctctttcccgataaattcttcaacaaactcatttgccgggtttcgaagaatctcatcaggtgtgccgacttgaacgatttctcccgcttttaatatcacaatcctgtcggcaagcttaatcgcttcatccatatcgtgggttacaaacacaatcgttttgtttaaggttctctgcagttttttgaattcttcctgaagggaatcacgcgtaatcggatcaagcgctccgaacggttcatccattaaaatgagagggggttccgctgccagggcgcgcagcacgccgattctctgctgctgtccgccgctgagctcatgcggataacggtctaaatactccgggcccatatccacaagctttaacagctcgcgcgcccgttctttccgtttttcctcaggccatttcaacagttttggtacaagtgagatgttctgctggatggtcatatgggggaacaaaccaatctgctgaatcacatagccgatttttctcctcagctcaaccgggtcctgttccataatattttctccgtcgataaagatccttccagacgatggttctatcagcctgttgatcatcttcatcgttgtcgtttttccgcagccgctcgggccgataaaacagataaattcacctttggcaatatctaaatcaatgctgttcacagcttttttgccgcctttatatacttttgacacttgttccaatttcagcaatccgtgcacctccgcaggtttcctttaaattttctgaaaagtataatccttattatagtttgaactttgtaaaataaaaagtttacaatgtgttgaaattatatgttatttatagattatttattgttatgaccgagacggaaagggtgttcttacaattacgccggatacctcccacttcctctgcattcagctattttcaacaccaggaagaaatatgatatattgacaccatcaattgccatttgaagggatgatcagctgtgaaaaaaaccgctctcgacatcattgaacatgctgaagagcatctcattgagaagattgccgaaaatatgcatacgtttggaatgccttcaactgtcggacgtgtgctcggaattatttatatgaatcgaaaaccaatgaccttaagcgagctctctgaggcaacgggcatgagcaaaacacggatgagccaggttgtccgggaaatgatcgatgccaatatcgccgaaaaggtgtttgaaaaaggcgtacgaaaagacctttatgacgtcgagcaggattattatcaaaccttcatttctttatttgcggcgaattggacaaaggtcgtgagcaaaaacaaagtgctgtataaaaaattaaaccgggaactgagtgatcttttacaaagggacgggcttaccccggaagcggaagagaaagtcaatcagctgctgaatgaattaaaagaatggcttcattactatgattggctgagcaggttgattgaattttttgagagtgaggaagtctttcggtacgtgccaaaaacaaaagaaagcagctctctaaaataagggagctgctttttgcatcatgaggttaagatcggaaacatgcctttcagccccgcaccaatcatcccgaccgcaaccacggctaagattaatcccatcagtctggtaatcacattcatctcggtttttccgagtttgctgctgataaaagcagaatagtggaaaaagagaaaggtcagggcaataacggcggctatgccgatcgtgacagccgcataatgactaatgccgctatgaccggcggaaaggctcattactgttgcaatcgttccgggcccagcaatgatcggaatggataaaggtgtgactgatatatccgctttttccttgctttccttatgttcatcatggtgaagagattgcacgtgtgattctttcgcattcaatagattataggcaatgccgaaaatgaatatgccgcccgccactcggagcgcgtgaatgttgatatcaaacagtttaaagataagatggccgaaaaccaaaaaagccacgagaataaaaaaggataaaatagctgccttccgggcaatcacttttctttccgctgcagtatagccttctgtcagcgtcagaaatatcggtacgtttccgatcggattcgatactgcgaataaagaaatgaagacgtgaacgataaatgagaacatcatatacctccttgttgatagtctctgcacaggaaatagaattattctccacccttttacccggaggcgatttcccggtaaacctttatagcctgtcagaaacgcgccatgctacaatgaagtgacaaattgaataggaaggacgtatacagatgttcaaaaaaattgcggcagatgccttgggcttatctgatatcggaaaaattatcgaacctcaggactatgacaaaacagacgcagacgactatgtcatgcatgaagataatgagaaaatttatttcttgattaaaacaaaagcagacgagtattgctttacgaacctggccctgatccatgtggacggcgaacgcgccacttcctcaaaacgaacgttgaaacgctatccttattcgcaatataaaatctctgacgtttttcttgaaactgccggaaaagtggatttggatgttgaaattaagttcaagctgggcggtgaacaattcgacattgatgtccacaaagaccagattgaaaagttaaaagacctttataaagcactgcttcgcatcgctgaaacaacctatgaaaatgacattttaatcaatcaagcggagcaaagcttagataaagcagtgacgattcttcaccatacccgccctgagcacgtcaatattgaaacgcaatacaaagagctgaccgaattcggatttacttggctgacatccgttcgctcgcagtatcatattaaggattttggagatgtatttgagaaatatattaataactagcataaaaaaagacacagctgctatcgggcacgtgtctttttttgtatgaatattgattactttacaacttttttcttttataataaaactattagtctattttccctatattacaggtaaaggagttattttatgtattgtcctcaatgcggccatcaaacagatggcggaaatttttgtgagaaatgcggatcaccgctctccggtcaatcaggccaccagcatgcagctcaaactggagccgctgcaaagcaagcagcaaaacagttcggttcatttgtcttatccgtcctgaaacgcccttatcaggaatgtaaagcaacaggcggagaacagctgatcagcgcaatcattacgatggttcttttcagtttgctgacccctttgatgttttatattcttttttcagacggtcccggaagcgtaagctttacagcaatcttcttagagccaaccatttattttattttatttctatttggcctgcatgcatgcatctttttcgccctgaaaatcgcgggaaaccaagtgtctttcaaggattcattctcaagattcggagcatttcttattccttttacggctattttgattcttgcccttttcttctttttattacatacagacatttgctttaccatattagccgttggtttaatcggtgcattcttcgccattcctcctgcgatgctgagcagttaccagcattcatataaagggaaggttgatgtcatttactcaacgattgtaatttatctgatcatctgcgttacatttcagcttattatcgaacactatgtcaaagaaattttccgttatatgctcttttaaaaacaacccatcacctgctggtgatggggttgttttattgaatagacgttaagtaaattcttccgttcttcactacgccggtataggtccagttatatgttctgagctttggactgccgcctgattttgtgatatagaattcttcatacgtcttaatcgtgatagccgacccattttggctccagcttttcacttcatagttattaaagtcttctgttgtcccctctttatttaatttcgacacgagatgctgctggtcggaataaagggaactgcctttttcaaggctgtcttccatcagtgagaaattattttgattcacggcatctgcctgactttgcagataactgcccataaataatgtcacttgttcatctgtaacatcgccgcttgcagagctttcactgcctttgtttttcgagccagcccaggcggaagtgtatgtctctggtttatcatttttgattttctttatatttgtgcctgcagattggaatgttgattctgcatcttcgaaaatccactttttctgttttttatcatatgaaagaagatattcataactcggactgtcgtcagtcatttcagattttgtatagtcgttatacgaagaagactggtgaagttcttttcctgttaccgatacctgccacgttccgtcgtttttctgagagagggcaaatgtgtccaggtcaaaatcagtttccaagtatctatcttttaagtatgaatccgcacttttcatagaatcgacggtgtccttcgtctccgccttccaattggcacttgcctctgtcatctgggctgtattcccatcagatagagctttggagtattgttttgttgttttgacaattgtgttcataatctgttcctgtgtatcttgatcaggaattaacgttaactccatttctttatcatcgatcggaacgccggcagtttttgtttttccccacggaaattctgcctcgactgaagctgtcattgatccatctgtcagcagcggaccatatgttacggatttgaacggatctttatgaattgatttaccgttaatcagcaaatctcccttcccgctcttgatgtcatccgctaagctgaatgtcacatcgtctgcttccaatgagagatcaacacgaaagctgctatcgccaaccgcctgaatgtcttcctttttcacaagatcgacgacatcgtttttcagtttggctgagactgtatattcgccgggaatgtacggaccaagggtttgtgcttgatcttctttctttacagatccggcttcctctttattgacatatagatcggtatttttataattgctgctcacttcaaaataaacaggtgctacctttaagtcataatggtcaaataccagcaggcttttcccgtctttttccgcatatacgatatccttctgggctgtttcatcccgcagcgatgcaaaaagttcatcttttttgtctggatgatccttcaaatatgtaagaaacggttttacattatttttagtgagtttaagattgtcatttaccggtgtaagtagagtcgcgatttggtcctgatcctcatcatttacggcctgttcaaacttgttaactaacctatcctttgaagtaaaatacgctccggttttatatgcggcgaataatataacgcacgccgcggcaatgctgctccataaaatgatggttttcttagggatcggttttcgcgaaacctgccttgtttctgcagtgctagctgtttcttgattcgcctgtttgctgccccctccgatcggggtgccgcattgtttacaaaacttggctccttcattatttttttgaccgcattccttacaaaacatgtggctttcctcctgtttgttacccgctatattttgtgcttatttcctatgttacatattttataatagaatggtaagaaattggagaaaatcatgaaaatatctctataaactatgaaaaggtggaatgataatgcaacacctcaccattcaaaaagcaacaaactttgatcaagcgctgtatgagcttctgctgctcgccgatccgtcaaaagaaattgttgatgactacttggtcagaggagaatgctacacaggttatatatcaggcgaattagctggtgtatacgtgatcatcacaactaggccacaaacggtagaaatcgttaacatcgcagtaaaacaaacaatgcaaaaacagggcattggcaagcttcttatcctcgacgccattgaaaaagcgaaacacatgggagcaaaggtgattgaaataggtactggaaattcaagtatccatcaattgtctctatatcaaaaatgcggatttcgccttcaagcgatcgaccatgatttttttatcagacactacgacgaggagatttttgaaaacggcattcaatgccgtgatatggtgaggctttatttggatctctgaaagcataaaaaaagccgccgagaaaatcccggcggtctttttattacttgtttaagttgtagaaagagttgataccgtggtattgagcagtttcagccaactgatcttcgatgcgaagaagctggttgtatttcgcaacacggtccgtacgagacggagcacctgttttgatttgtcctgcgtttgttgccacagcgatgtcagcgattgtgctgtcttcagtttcaccagaacggtgagagataacagctgtatagcctgcgcgtttcgccatttcgatcgcatcgaatgtttctgtcaatgtaccgatttggtttactttgatcaggatagagttgcctacgtcgtttttaataccttcagcaagttttttcgtgtttgtaacgaagaggtcgtcaccaacaagctgaacttttttaccaagacgctcagtaagaagcttgtggccttcccagtcgttttcgtcaagtccgtcttcgatagagatgattgggtatttagaaacaagctcttcataccagtcaaccatttcagcagatgttttcacaacgccttcgccagacagatggtatttgccgtcttctttgttgtagaactcagaagatgcagcatccatagcaagtttaacttcttcgccaggtttgaagccggctttttcgattgcttcaacgattgtttgaagcgcttcttcgttagaaccaaggtttggagcgaatccgccttcgtcacctacagcagtgtttaagccttttgcgcttaatactgatttcaggctgtggaagatttgagcgcccatgcgaagtgcttcacggaagttaggagcacctacaggcatgatcatgaattcttgaatatccacgttgttatcagcatgctctccgccgtttacgatgttcatcatcggtacaggaagcgtttttgagttgaatcctccaaggtattggtaaagaggaatctgtaagaaatcagcagcagcacgcgcacaagccatagatacgccaaggattgcgttcgcaccaagtttgcctttgttttcagtaccgtcaagctcgattaaaagctggtcgattgcgttttgttcagttacatcaaagccaagaagctctggagcaatgatttcgtttacgttgttaacagctgttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgttgggttgccgcgggagtctaatacttcgcgtgcataaacatcaacaatgtatggcatgagttttgtctctccttttgattttcaaattatttttgaattaaagatgttcctgtcatttctttcggtttttcaacaccaagaaggtctaataacgttggtgcaaggtcgcctaggattccgccttcacgcagcgtaatgccttctttcgttacaatcacagggactgggtttgttgtatgcgcagtgtgcggttcgcctgattctgtaatcagaatgtcagcattaccgtgatcagcggtaatgatggcgtgtccgcctttagcaagaatcgcgtcaacgacttcgcccaagcattcgtccactgcttcaattgctttaattgttggttcaaccattccggagtggccgaccatatcagggtttgcgaagttaagaatgatcgcgtcatgcttgtcagcttcaatttctttgacaagcgcgtctttcacttcatacgcactcatctcaggcttcaagtcatacgttgcaactttaggcgagttgatgagaatacgctcttcacccgggaattcagcttcacggccgccgctcataaagaacgtgacatgcggatacttttcagtttctgcaattcgaagctgttttaacccgtgctgagataatacttctccgactgtgttatcaagatttatcggtttaaacgctacatagccgtcaactgtttcactgaagtgagtcaggcagacgaaatacaggttctttggataattctcgccgcggtcgaagtcacggaagtctttgtttgtgaacgtgttggaaatctggatggcgcggtccggtctgaaattatagaaaatcacagaatcgccgtcttggattttcgcaacaggctcaccgttttctcttgtgatgacagatggaatcacgaattcatcgtagataccatttgcatatgaatcatcaacaacatccagggcgctgcggtaagaagggccttcgccgtacgccattgcgcggtacgctttttctacacggtcccagcgtttgtcgcggtccatagagtagtaacgtccggaaatgctggcgatttcacccacaccgatttccttgatttgatcgttcagctggttgatgtacgttttcgctgtctgcggacctacatcacggccgtcaaggaagccatggatataaacctttgtcagcccttcttttttcgcaagctttaacagtgcgaataaatggttgatatggctgtgcacgcctccgtcagataaaagaccgaacaggtgcaaggctttgttgttttctttcgcgttgctgatcgcgtcaaggaatgtttgattgcgttcgaactctccttcgcgaatggcaacatttacgcgtgttaagctttggtacacaatacgtcccgcaccaatatttaagtgacctacttcggagttccccatttgcccttcaggaagacctacagcctcgcctgaagcagtcaatgtttgatgaggatactggttccagtagcggtcaaaattcggttttttcgctaaagcgactgcgttccctactgtttcgttacgtaatccgaacccatcaagaatgatgagtgcagctggttttttactcatattgaccttcctccaataattgaacgaatgactgtggctcaaggctcgcgccgccgaccaaagcaccgtcaatatcggactctgccatatattctttaatgtttgcaggctttacgcttccgccatattggatgcgaagcttgtctgcagcttcttggctgaagctttcagcgacggttttacggatatgcgcacacacgtcattcgcatctttcgctgtagaagatttgcctgttccgattgcccagattggctcatacgcaataacagaagcagcaacttgttcttcagaaagaccagcaaggccttttttcacttggtcagcaacaagatcatttgttttgccggcttcacgctcttcaagcgtttcacctacacagatgatcggtacaatgccgtgtttgaaagctgcgtgtgcttttttgttaactgtttcatcagtttcagcgaacatttcacggcgctcagagtggccgatgacgcagtagtcaacgccaagatctttcagagcaaccgggctgatttcacctgtgaacgcgccgctttcttcgaagtgcatgttttgagcgccgacttttaggtcagtgcctttaacagcagaagcaagcttttctaagaaaagcgctggcgcgcaaacaacagcttcagctttgtctgctgctggaatggaagatttcacttcttcaacgaagctgacagcttcgccgagtgttttgttcattttccagttaccggcgataattggttttctcatctgttccacttccttatagcagttttgagattatttatcgttcagtgcagctacccctggaagctctttgccttccataaactcaagggatgcgccgccgcctgttgagatgtggctcattttgtcagcaaggccgaatttttcaaccgctgccgcagagtctcctccgccgatgacagagtatgtatctttcgcctctgccaatgcttccgcaaccgcttttgttccttgagcgaacaagtcgatttcgaatacgcccattggtccgttccacacgacaagtttgctgttttggatgacgtcagcatacgtttcgcgtgttttcgtaccaatgtcgattgcttctaaatcactagggatttcagagatcggcacaattttcacgtttgcatcgttagagaaatcatctgcaacgagtacatcttcaggcatatagaagttaacgcctttttctttagcgcggtccataaatgatttcgcaagctcgattttatcctcttcaagaagagatttaccgacttcatagccaagcgcttttacgaaagtataagcaagacctccgccgatgatcaggttgtctactttatcaagaagactctcgattacaccgattttgtcttttactttcgctccgccgatgatcgctgtgaatgggcggtcaggattggaaaccgcttttccaagtacatcaagctctttttccattaagaaacctgcaactgctggcagatgctcggcaattccagctgtagatgcgtgagcacggtgggcagcaccgaatgcgtcatttacatatacatctgcaagctcagcaaatgcttttgcaagctcaggatcatttttctcttcaccaggatagaaacgtacgttttccaatacaagaacgtctccgtccttcatctcggaaatttgtgcttttacagcatcgccgtatgcttcatccgcttttttcactttttttccaagcagttcgccgagacgtgcagcgacaggagttaaacgaagctcctcaaccacttcgcctttcgggcggcctaagtggctcgcaagaaggacttttgcgccttggtctgcaaggtgtttgattgttggaagcgcagcacggatacgtgtatcgtctgttacttccccgtctttcattggaacgttaaagtcgacgcggcagaatacaactttgccttttacgtcgatgtctttgagagttttcttattcatgcctaggagatcctccttcaaaatggtttgcaaacagcacgaaaaacgtgaaaccgtctgttcaagcgataacgccgctagggcagatcgcagtctttttcggcacagggcagttcgtctaaaagccagggcagcggccttaggcgaaagtgccggcaaagctgcttaaaacgcggtcgtttctctatcacagagcgttttctgaaagccggtcttcatggaaaaagggaaagggagtccgtccccttcccttgtccgctttcattatagcgcttctattcgaaagaaccaagtcaggtcctttttcagctataaattaaagacctttttttgcgatgtaagctgcaaggtcaacaacgcggttagagtagccgctttcgttatcgtaccaagagattacttttaccatgctgccttccataaccattgtagaaagagcatcgattgtagaagagtttttgtttccgttgtagtcgccagaaactaatggctcttcgctgtagccaaggattcctttaaggtcgccttcagccgcttctttaagagctgcgtttacttcttcagctgttacttcttggttcagttcagcaaccaagtcaactagagaaacgtttggagttggaacacgcattgctccaccgttcagtttgccttttagttcaggaagaactagagaaactgctttagcagcaccagttgatgttgggatgatgttttcagctgctgcacgcgcacgacggtagtctttgtgcggaagatcaaggatttgctgatcgtttgtgtaagagtgaacagttgtcatcataccgcgtttgatgccgaatttatcgttaagtacttttgcaaacggcgcaaggcagtttgttgtgcaagatgcgttagagataacatcgtggttagccgcatcgtatttatcttcgttaacacccataacgattgtgatatcttcttcgttagcaggagcagagatgattacttttttcgcgccagcttctaagtgtttcgcagcgtctgcgcgttttgtgaagaaaccagtagattcaactacgatttcaacgccttgtttgccccagctaagtttagcaggatcgcgttctgcagaaacttcaattgttttgccgttaacaacaaggttgttaccgtcaactgaaacttcagcgtctaattttccgtgtacagaatcatattgtaaaaggtgagccagcatgttagcatctgttaaatcgttaaccgctactacctcaacttcaggattgtttaatgctgcgcggaatacgttacgtccaatacgaccaaaaccgttaataccgacttttactgccatgattgtttcctcctttaaataagtgagagatatttatattgagggattattcatcccttaataacttctttgcggctccttcgtctgtgacgagaaccgtgttgcgtggctttttaaagtaagcctcgatcgcctcggcttttgatgatccgcccgctaccgcaataatatcggggatggcatctatgtcatccagctgcattccgacagaatgcactttgtgaaccacttcgccgtccgcgttaaaatagtagccgaacgcttctgtcaccgcgtcgttatcatctattttctttaagtcttctaaaggcgtgtttctgcgctgagccatagttttagcttcgccgattccgtgaaccagcatactcgctgatttaatggtgttcagcacctctttgacagaaggctcttcaataatagatgaataggcgccttgtgacagctgtcccggaacaaacaaaagccggtaagtgcctgaagccttctccgccatatgcgcgcatatggtgttcgcctggtttttcacatcttcgcctaaaccgcctcttgcaggcacaaacaaaagctcgcggtttttagaatccggcgtcatcatttcggcgacagcttcaattgtcgtaccgccagttacagcgacgatatttttgcctgaaaatctttttttcatacatgcgacagccgctcttcccatttcttttttgacccatggggattgatcgctgtctccggatacgataatggcatccttcagatttaaacgttcttttaatgtcttttccaaaagagtcaaacctaaaacatctttcatcgtatcttccaaaacagaaagcagttcatagccctcttctgtcaatgtcatgccgtttgtcttaatatcgaccaggttctgttcctttaaaaactgaacctcgcccctcagcacacgctcgctgattccgagactggcagacaggcttcttcgcccgatgggttctgtcagcctgatatactgcaagatttcaaacctcttttgcataacgagcagaagatcaggcaataattttttttgagcttgtattaactggttcatgactcaaacgttccttccttttttgctggacattatatgtcccgctatgacaaaaaacgtcccgtcatagccaaaaaaaatcatttctgctttctttaattattttaacagggtggaattgtttattcaactgttaagagccaattcatcgacaatattcgcagagttttcatgccgcgtcgttttatccagcaatattttatcctatatatctttatcttatacagaaagcgccaaatggtgcatcccaatataaacagcccttcccgtagaaagggctgtttcattaaagcgttttcattttatccaaagcttttcaatttcctcgagcgatttgttcttcgtttccggacagatcgtaacgacaaacaggaaacaaaggatgttaatcaccgcaaagatccaaaatgtataggcgagcccgaaagaatcaatcatcattggcacaaactgtccgatcgcccagtttgctccccataaaaagatggtcgcaatgcccgcggcccgcgcacgcagatggttcgggaagatttcagaaatcataatccatgtgatcggtccgaccgagacacagaaagcagcgacaaaacctaatataaggacgatcatcatgatcccgcttgttaactcaaaataaaacgacgtcccgattaaaatcataaaaatagccataaaagcagaaccgatggacatcagtttttttcgtccgactttatcaatcagcaacaccgcaataacggtaaaaataacttctacaaccccgacgatacaagtcgtcacaaatccggcgttttgcccgaatcccatcattttaaagatttccggcccgtagtaagtaatcgcgttcatgccgatgacttggttaaacagcgccagcaggattccaatgacaagcgcctttctgagacccggcttaaacagctgggagagcgaccccatttgttctatttttaaagagttctcaatgttctttaattcttcttttgcaacagtttctccattaatacgtgtcaggatctttaaagcttcatttgttttgcccgctttcgccagccatctcggactttccgggacgacgagcaggacaaggaaaaaaatgacggacggcaccattccataagcaagcatccatctccagccggtgtgcacgccccattcgtatgttccggaccgctgcacagctagattaataaagtatgttgcggaaatccccagtatcgtaaagagctgatataaggaagataaacttccgcgtatggcgggcggtgccgcttctgtaatatacgtaacagagagcgatgagcccatcccgattcccagccccccgataatccttgcaatgattaaggtggacacgtcttgagaaagcgctgaaacgattgctgatatcgcaaataacaaagcggctgtcattaaaatttttctccggccgaatctgtcacttaaaaatccggatatcccgacgcccacaactcctccaatcataatgcttgaaatgacaagtccctccataaacggactcaggctgtataaatctttcagaaaaccgatggcgccagaaatcactgccgtgtcatagccatacaataagccgccaagccccgccgcacatgagatcaaaatgacaaatcccattgaatggcttcttgttacaggaacatttggttctaattgagttggagtattcttcatttccctgccctcccgaatgttgagtaaagcgttttcattcaaaacttcaattgtacgtacttatattaaaatttaacgaaaattacatttaattagtacgtacaaatatagaataatcttgtttgcattttctgtcaatgttttcttacaaagaacgctgtgatatactgaaatttgtccgtatacattttggaggaatggatatgttaccaaaatacgcgcaagtaaaagaagaaatcagttcatggattaatcaaggcaaaatactgcccgatcaaaaaatccctaccgaaaacgaattaatgcagcaattcggcgtcagccggcataccatccgcaaagcgatcggagacctcgtatcacaaggtctgctgtacagcgtgcaaggcggaggcacctttgtcgcttcacgctctgctaagtcagcgctgcattccaataaaacgatcggtgttttgacaacctacatatcagactatattttcccgagcatcatcagaggaatcgagtcctatttaagcgagcaggggtattctatgcttttgacaagcacaaacaacaacccggacaacgaaagaagaggcttagaaaacctgctgtcccagcatattgacggactcatcgtagaaccgacaaaaagcgcccttcaaaccccaaacatcggctattatctgaacttggagaaaaacggcattccttttgcgatgattaacgcgtcatatgccgagcttgccgcgccaagttttaccttggatgatgtgaaaggcgggatgatggcggcggagcatttgctttctctcggccacacgcatatgatgggtatttttaaagctgatgacacacaaggcgtgaaacggatgaacggatttatacaggcgcaccgggagcgtgagttgtttccttctccggatatgatcgtgacatttacaacggaagaaaaagaatcaaaacttctggagaaagtaaaagccacactggagaaaaacagcaagcacatgccgacagccattctttgttataacgatgaaattgcgctgaaggtgattgatatgctgagggagatggatcttaaagtgccggaggatatgtctattgtcgggtacgatgattcacatttcgcccaaatctcagaagtgaaactaacctctgtcaaacatccgaaatcagtgcttggaaaagcagccgccaaatatgtcattgactgcttagagcataaaaagccgaagcaagaggatgtcatatttgagcctgagttgatcattcgccagtccgcacgaaaactgaatgaataaaaaaagcaatgtatgggtctccccgctacattgctttttttatagctgttatctgtttttccaaacgtcagcgatgatttcaaacgaacgcattctgtctgcgtgttcaaaggtttctgagttaaccataatttcgtcagcctgtgtcgttttgacgaaatcttcaagcttcgccttcacttcttccggacctccgacaatcgtggagctcagctgctcattgaccatcgctttttcatacgggctccagatttgatccatatcctcaacaggcggtttaagctggttcggcgtaccgcggacaagatcaagaaacctttgataatgcgaagtcgcaaggtgctgcgctttctcgtttgtatctgccgcgataatggtgacaccgaccatcgcatacggttcgtcgagcacgtctgacggcgtgaaggaattgcggtacagctccaaagcgggaaccgtattcgccggtgagaaatgagcggcaaaggcaaacggaagacctaattcacctgccagacgggcgctgaagccgcttgagcccagcagccaaatcggcacgtctatgccctctccgggaatggcgcgaacttgattgcgcacatttcctgacggtttaaaataattgcgcagttcctctaattgttctggaaaatcctccccgctgttgatgtttctgcggagtgctctggctgtcaactggtctgttcccggcgcacgtccaagccccagatcaatccgaccgggatacagtgtttccagtgtgccgaattgttcagcaatgactaatgaagagtggttcgggagcataatgccgccggaaccgacgcggattttcttcgtgcctccggcaatatggccaatcaaaactgcggtggcagagcttgcaacaccttctatattatgatgttcagcaagccagtaacggtgatagccccattcctctgcccggcgcgccaagtccatgctgtttcggaatgattctgcaatcgttcctccctgaacaaccggagataaattcaagacagaaagcaaggtatctttgcgttggttgttagacatattgttctcctttgcaaatgtgttatcagtaaacagcccaaagctgtcaggtcatgattgtaagaacttctatcacaccataacacaactgcattcaggaataaaagaatttgattcgatgaaattcgaacaatataaaacgaacggtttggaacattattctgctccaaacagctccttagccatctcaataaagagcttagccgccagagaagcctcctttagcgacggaacagcaagctgcacatcacggtatacctgcgggtccaattcccgggtcaccacatgctccggaagcggcatccccgacatggacatttccgataaaatggccaggcccaggccttctctgatcatactgatcgaggtgttgatgttatagaccgtgaaagctgggtgcagcgtagcacccgcctgcctgaacatatcgataaatggtgattcatagccgccgtcacagacgatcatcggttcatggtcaagatctttcagcgtaatggctgaatgactggcaagcgggtgatcgtccctgagcacgacagccattttgtcttttttcaaatgaatgtactccatctcctctgttggatacagaagaatcccaacatctatcatccgcgtatgaagccactccttgacttcatttacagttccctcgtgcagcacgagctcaagtttcggatatttttgtttaaattcactgatcagcttcggcataaaataagccgaggcagttgagaatgtgccgatatggatcgttcccagttcaagccctttttccgctgctgctacctgctcaactttttcaatgccttttaagacttctctgatgtgtactaagatctgttttcccgtatctgtcagcatcaggccattgcggcggtcacgaatgatcagctttacatcaagctcagcttcgatcgcagaaatcgcatggctgacagccggctgtgtcatgttcagcgcctgacccgcttttgtaaagcttccagtttcagctattttcacaaaaacctttaattgtgtaatggtcataacaatttacttatgctccttataaaaaagattcattttatttatcttatgttctaccgtatcatatgatggaaaagttctacaaggagtgaatgaacaatgaagcagctctcaaaaacgcggacagctctcctgctcgcatttctcgtcatcatgtggggcgtcaattggccgctgtccaaagccgcgctcgcctattctccgccattattgttcgcgggcatccgaacgctgatcggcgggcttttattagtcattgtcgcactgccgcgtattcataaattacgcttaaaagaaacgtggccgatttatcttgtttctgctcttttaaatattacattattctacggcctgcaaacgatcgggctgaattatcttccggccggcctgttttctgcaatcgtcttcttccagcctgttctgatgggtgtattttcttggctgtggctcggcgaatccatgtttgtaatgaaagtgattggcctcatcctcggttttgcgggagtagccgtcattagtgctgcgggctttggcgggcatatttctgtcattggggttctgctggctctcggctccgcaatcagctgggcgctcggaacggtatatatgaaaaaaacaggcagccgcgtcgattccatctggatggtcgctctgcagctgacgatcggaagcgtgtttctgcttatatccggcttttggacagaaagcttttcggcgatccaatggacagctccgtttattacaagcctgctgtttatctccgtattcgttatcgcactcggctggcttgtcttttttacgcttgtcggttcaggagaagcaagcaaggtcgcatcttatacttttttgattccgctcatatcaatcgtggccagctccattttcctgcatgaaccgctcacccttagcctcttggcagggctgctgctgattgtcacgagcatctgtctcgtgaatacaaaatcaaaagcgcagaaagctgcggcgattggtataaacgagaaagctgcacaataataaaaaccctcttgccggatgcggcaagagggtttcttatttactgatgcttgcgtcctttgaccaaatatgcaactgtaatcaaaaggtagatcgccgcagtaatgccagtaatgacaattgatgttgtcatgatgaccccgatcagaatggcgagtaatgccacaatcgcaaaccatgtcgtgtacgggaaccattttacataataagccggtgtttccgtttgctgttttctcgattttaaatgagcgaatccgatgatcagccaaatgaataaaacggtatatcccaatgatcccattaaataattaaatgtttggcttcctgcgaacagagaaatcaatacgccaatatagagagaagaagtgcacatcagaatcgcaaacatcggtacgtttttcgatgaaagcttcgagaagacctttggaagccttccgtcacttgcctgtgtatacaaaatgcgtgatgatccgtataaacctgaattcatagaagaaatgatcgccagcaggatgactgcattcatgatatgatccgcgcccggaatgcctaccattttaaagaccatcacgaaaggactttccggaacggaattgacttggttccatggaatcaggctgacgatgatgaaaaacggcagcaggtaaaacgcgacaatccgtgtcagtgtgctgcggacagctttcgggacaaccttttccggattttttgtctctgcaagcgttacaccgataatttctgtaccgccgtaagagtagatgacgacaagcatcgccgtgatcagccctgtgccgccgtgcgggaaaaatccgccgtggtctgtcagatttgaaaatccggatgctgtatgatcaccgaatgatacaaataagagcagcaatcccagaataataaagataataataacggtaatcttgatcattgccagccaatattcggtttcggcgaagattttaacagaaagcaagtttacaatcgtgacgataagagaaattcctaatgccaacacccagatcgggcagcccggcagccaatattgaatgaaaatcgcagctacaacagcttcagccgcaatgttaagcacccacattttccagtagatccagtccaaaaagtaagcggcgtagtttcccaatacctgctggacaagatcacggaaggttctggcgttacggtttcgaacagccatttccgccagcccctgcataataaacagcaaaataatcccgccgagcagatatgcgataatgacagatggccctgccacatcgatcgctgagctgctccccttaaataaacctgcgccgattgctccgcccagcgccatcatcataatatggcgggacgtcatcgtgcgttttaacgtttgattgtcgtttttcatcctcttctacctctccttctcgttttcaaaaacaaaaaagcccgccgtctcctacctaatctaatagataaagagacgacgagccttcggctgaccgcggtaccactcttgttgattcttcatgaagaatcctgcttttgacctgtaacgaaggttagccgttaaaacatagggaatattcaatctattccgttccgtcttaccactcccgggcgagttcaaagaagaatcaggctgcgtcgcaccaccccgcagctctctgttctgatcactttcttttactgctcccaatctatgtgttttagttttctgaaaaactcaaattttatgatctgaatatattaacataatatacgtgcttctcttttaactgtcaataacttcagagaaaaaagaaactgttattttgtcccttttcgaatggctttccaaaaggattctgactcgtttcctaatgcgtaaactgaaacacctgctattttatattgctttgccagatggcttttcgtttgaacggttttttcgttttcataccacacgacatgtttatgcttctttttgtcaacataagaaaacgtcatcgagcctgattttttgttgaatgccggctttgctttttgttttttgatgagggatttgagctcattccattcccttattgtgctggtacttccgtcttttacatcccagtcatagccgtacgcagggattcccatgatgactttattggctttgatctttttgactgaaaactgcagagagcttttgatccagtttgtgcttgccactgaccctggctcaccccaaatgccatgttcgtcgtaggtcatgacttgtacgaagtcggcatatttgccgattttcgcataatcatacggccagctccagtcatcatttttatcatcggcgcttttggccggaacggataccattgttttaatatgtttcttattcaaagcctgtgagacatattgaatgaagttcgagtacgcagcgcggtcttctggatttactgcttcaaaatcgatattaattccgtaatatgagtgctttttggccagtgtaattaactgatctgtgaatcgttttttcgctgttttattactcatgacccgactcgctaaatctccgtcaaaatcataaatggcatcattatagtttgaaatgacagcccatgtcttgatttttttctttttggcatatgtcagctgcttagttgggggggcatcgccaatcacatgtccgtttttttcaaacgcaaacgtatcggttgcgatggcattcatgtatgtatgatatttcgtaagagaattgtatgaagccgtatccccagtcgtgtagcctagtgtcattccggctgccttcgcttctgtttttgtatacataaacagaacaatcgcaatcgccagtgaaaccgctatgatcagccattttttcatcgcatttcctcctgtatcaagtcatactcttctcatcggccaaaaaattggaagttgaagttttttcaagcaaaaagcccggcatatgcctgccgggcttcctgagttcagcggtcagagacgagaatatatgctgcctttacaggtccgtgcactcccacaactaaatccatttcaatgtctgctgagttgctcggtccggtaatgtagttgatacatgaaggaacagtgacaccgtccgcaatgttttggcggatgatatcactggcttgtgtcattctcggtacaatgcttgatttcggcacgatcgcaatataagtcgtcggcagaaggctgacagatcggccgatgtcttttgaggagaagaggacaaccgtccccgactcagccaatgtaatttcgctgaatgtaatccctacattggcttgctccgcttttttgatattttcctcgcctttgtcagcatcccactcccagaccggcgttccttcactcggccagtccttggtgagcaggcttttcagtccgtattcttcaaagcgggggtccttcggaatgatgacagggcctccggaaaagccgctgacttgctcgcgcagggcatcataaaggccggttgaatccgtttcaatcagctctgtatggattttgacacaatggtttttgagcactgtgactaagtcatccgctgaataaccttcaagtgttttatattgcggctgatgcgcccattcagggactgccacgcctcctgttcttctttcacggcccaggctggatgcgattcgatttaaaaagctctcttgattctgaatggttcccttcgtcatcactgctcctccttcgtgcgttcacttgtttctctgtccgcaaaccagtctctgaatctcgatttatgcggtgccgggaagtcacggatctgtgtccaatttttaagcgggccgggccctttcgaaattttttcgtcctctgtaaaaggcgtcatggcggccggcgcccattttgagcccattttgtaaagcgataaggaggatgcgccaagtccgaatgctttcattgcaagcttttcactgatcggcgctctgccttctttttcgacgatattctgacgatgcttgagtagcagctcatgaagcgggattttgaccgggcaggcttctgaacaagcagcgcacagtgaagacgcgtacggcagctccttataatcatcataaccgccgagcaacggcgataaaaccgctccgatcggccccgagtagattgagccgtatgaatgtccgccgacatggcggtacacaggacagacattgatacaggcggcacagcggatacattgcagcacagactggaattccgttccaaggatattggatcgtccattatcaacgatgacaagatggaattcttccggaccgtccacctcaccttccagcttcggacccgtcaaagctgtaatataacttgtcagccgctgtccgacagcacttcttgtcagcatgctgactagcacttcaaattcagaaaatgacgggacaatccgctccattcccatgacggtaatttgtgttttcggcaaggtgctcacaagccgtccatttccttcattggtcacaaggctgacagaacccgtgtcagcgatggcgaagttacagccggtaatgccgatatccgcttccagaaactttttccggagaatggcgcgcgcatgcatcaccagctcttccggtttttctgtatgttgatagtccagcctttctttaaacacatcgcgtatctgctctttatttttatgaagggcgggcgctacgatatgtgacggcggatcgtgatcatcaatctgcaaaatatactcgccgagatcggtttctacgacttcacagccttccttctccagcacctcattcagattgatttcctctgtaaccattgattttgattttacgattttcttcccgttcttcttttgaatgacatcacgaatataggaagacgcctcttccgctgtttccgcaaaatagacatgtccgcctcttttcgccacattatcggcaagctgtccgagatagaaatcaaggttttcaaggacatgctgcctgatttcctctgataatgagcgccactcctcccagtttcccagttcttctgctgcctctaggcgccgcgtccgcagacgctcctgtgcacccgaaacagcacctctcataaattcattatcaatcccctgtgatacccgctctttaaaagcgtcagtaccgattttcatcgccatgatcctttccccctctgaatccagttttatctgctgttgagcacttcggcgatgtgcatcactttgacattcttatcttttcggccaagccgtcccccgatattcatcaaacagccgcagtcagcaccgatcagcacctctgctcccgtttcctccacacattcgactttttcatcgaccatctgctcagaaatctgcgccatcttgacggagaacgttcctccgaatccgcagcagttatgtttgcccggaagctctgtaaactgcaggcccttcacatggctcaacagcttcatcggctcctcccgaacacccagcagccttgtcatatggcacgacgtatgtaaggtcgcttttgtatgaagggtcgcgccgacatcctctactccaagtacgttcacaataaaatctgtcagttcatacgttttatccgccagcttttgcgctttatcggcccatttcggatcatcctgaaacaggtgcggatactcccggaacatcgttgtgcaggaaccggaaggactgacaacatattcagaatcctgaaacgtttcgatcatccgtttcattgcttttttggcgtcatttacatagccgctgttgtaagccggctgcccgcagcaaatctgcccttccggaaaatcaacctcacacccaagccgctccagcagctcaaccgttgcttttccgacatttgtttgaaacatatcaacaagacaagtgacaaaaagtgagactttcatgatgaacccctctctcatccccaatatatgatcaggtcatctgatgacctgagttaaaataactatatgaatatcgtacactattctgacaatggaagggaagggttttctagggatattttcatttgtggcatataaaaacactcccgatctcccaggagtgcagtatatggttaaatccagcccttttcctcagcgatgctggcggcttctgtccgatttttcgcattaagcttttggatgatttctgagatatagtttcgaactgtgccttgagataaatagagctccagcgtaatgtcttttgttgtcttgcctaaagccgcaagcctcagaatttcttgctctctaacggttagcggattttcgtctcgcatcatattaaacgtcagctcagggctgaagacacgttttccctttacacattttcgaatggcatcggccagatcgtcaatttcgccgtctttcagcagatagccatgtgcaccggcctttacggcgcgttcaaaatatccggggcgagcaaaggtggttaaaataatgaccttgctgacgcagccttttttcattaattcctctgccacatccagcccgcttcgaaccggcatttcaatgtccataatgcatacatccggctccagcttcaaaatagcatgtagcgcctcttccccgtttaatgcttgtccgatgactgtcatatcctcttctaaatcaagcaaagatcccaaagcgcctaaaagcattcgctggtcctcagcaataaacagacgaatcattcttttcgtcctccaatcattctgcttttttaataagcggaatcgtcagtgccacaaccgttccgttatgatctgaaaccgttaatcccccttcaatgagcatgagccgttcttccattccccgcaggccattcccaaacattttctcctttggcgctccctttccgtcatcccgtatcacgatcctcattttgtcagcaaactgagaaatggtgatggcacagtgggttgctttgctgtgcttgataatgttagtcacggcttcccgcatacacatactgataatattttgagtgacgggagatatcgctgaaaagtcgtcggctccttcgtattgaaaggtaatgttccccgctcttaatatgtgctgaatgtttacgagctcctctgttatcgtgaccgtcctcatatcagaaaccagctctcgaacttgcttgagtgcggatcgtgagctggtttccatttcttttgcctcaagcttggtccgttctggatcagatgcagccagccgctgaatgagctggctttttaatgtaagcagcgacagggtgtggccaagagtatcgtgaagatcacgggcgattcgaacacgctcctctcttttagagagttcttttatctgttcgttggcttgtgcaagcttattttcaagctcaattctccgaaacatagaacgaatgccgaatggagaaatgagcataatgacgagaaacgggagaacagaaaaaagctcccggagcgagaccgaattcgcgataaattggtataggcatggaaaaagcagtataaagattaaagcgcagaacgcacggttaaaattcgttttctctttgaaatagccaacaaagtttgccgggaaaaaacctaagtatatataggtgatattgtaaaacacactatacatcaaaataaccgccatttgcacgataagccaatatgtaaacgaagctttgcccacgctgcagaataactggcgatatgccgctacaaaaaggagcagcatgccatatccgatcccctgtttgacccctgattctttcaataaagagaggaacggcataatcgtatacaccagaaagatataagggaaaaacccgaattccttcgggaaaatagatattgcctttttcatgtattacaccgcttcttgttttcttcttatatatttagatagtagcatgaagagcatcatataagcgattaatatcagaatatttttccaagtcggactcccaccccggacaagttcccacgctccgctcccgaaatgataagacggaagccactggccaatgctctgcatcatgtcaggcatgacctcaaacggtatccacatccctccgcctaaagccagcagcatataaagcacattactgattccggccgctgtttctacttttctcatgaggccgattagtgtgcctaatgctaaaaaaaggcaatgcgccaaacaaaatccacagtccgctcatcatccattcaaacggtgacaaggcaatatcattgatgactgcgccgaacagaaatatgacggtaatcgataaaacgtgaatgacactttggccgatcatctgagctgataaatagatatgatcctgaagaggcgtaaggcggataaaggcggcccagccttgtgaccgttcttgtaccattcggatgccaagcgtcatgatagaggaacccatcacgctgaagactgtcatcgacatcaggtaatgggcttcccatgcacgttgatcagggacgttggtattcactacatttgtaaagaaataataaaaggcaatcggcatgatcagagaccaaagcacaaagtacttgttcctaagcacccttttcatttcagcgatgctttgcttttgcagcatgttcactcacatcgcctccctgttgccgtcagccagctggcgaaatgcctcatcgagcgtcgcttgctcaattcgaatatctcgtgctgggatgttttcttgaaagatcagcgccaacactttgtctgtatttgatgtctggatgatggttctctcatgctcgtggatcactctttcgacttccgggtgacaagacagcctttccaatgattcacttgaatgaagcataaaggaaacagactgtttttgcattcttgagcggatttgcattggtgagtcgtctgcaacaagctgtccttcagtaaaaaataggattcgctgtgcggcatcgtctgcttcctgtaaataatgagttgaaaaaataattgtttttccttggtccgacagtccgtgaatggtctgccagaatcggtgtcttgatgaagtgtccatgccgactgtcggttcatcaagtataagcagctccgggttcccggcaagagccaaagcaaagctcaaacggcgtttttgtccgccggataatttttctgctcttgttttcaaatcttctttggtgagtgctgttaacgaaacgagttctttcatggacaatggattcggataatagctccggaagagttcaaggatttcatccaccttaaggcccggcatgacacttacttcctgaagcattacacctattttttcacgaacctgttgatcatcgggaacccggttaaatagtttgatttctccctcactcggtttcagcaatcctaatatcatagagatgacggtcgtcttccctgccccatttggcccgagaatggctgcaatttctcctttttcaatactgaagctgatgtggtttacagcggtttttcgctggaaatgttttgtcacgttgcttactgttattgcttctttcatcacatgagcacctcctgatcgtttacattgattgtaaaatgacggagaagacgatgttagtatggggtgtcatgatgatggagtgacaaatgtcattttcttactcaccccggtatctaggcaatcctcctcctgcatcttccaattcatccatcttttctatctcccatgtcctctttcttttaaactgctgtgacattcatagaaagatacactcttcaaaccatccgagtgttatgatagatctattgaactttatattactttccggctgaaaggagccaatcatgaacgaagcgattttgtctagaaatcatgtgaaggtgaaaggcagcggcagagcatctatcatgttcgcacctggttttggatgcgatcaaagtgtgtggaatgccgtggcacctgcctttgaagaagatcatcgtgtgattttatttgattacgtcggttcgggacattcagatttgcgcgcatatgacctgaatcgttaccagacacttgacggctatgcccaggatgttcttgatgtttgtgaagctttagatctgaaggaaaccgtgtttgtaggtcactccgtcggggccttgattgggatgcttgcatccatccgccgcccggagcttttttccaatctggtgatggtggggccttctccttgctatttgaatgatccgcctgagtattacggaggatttgaagaggagcagctccttggcttgctggagatgatggagaaaaattatatcggctgggcaactgtatttgcggcaaccgttctgaatcagccagatcggcctgaaattaaggaagagcttgaaagccgtttttgttctactgatcctgtcattgcccgccaattcgcgaaagcggcgtttttttctgatcaccgagaggatctttcgaaggtaacggttccctctcttattctccaatgtgcagatgatatcatcgcacctgcaacagtaggtaagtatatgcatcagcatctgccttatagcagtctgaaacaaatggaggctctcggacattgccctcatatgagccatccagatgagacgatacagctgatcggcgattatttaaaagcacacgtgtgatataggaacgaaagggatagaggtgaccctcttagatggacaaacaattgaatgatgcaccatgcggtttcctcgctttgtcagaagaggggtcgatcatagctgccaaccgcacccttatcaagattctggattatgagccggagcaggttatcggccagcacatgaatatgatgttgaccattcccgcacagcttttctgccagctttatttttttccgcttttgaaattagagcatcacatcgaagaaatatacatttccctgaaagctagagatggagaagaaattcccgtccttatcaatgctattgcgagacacgatagcggggcttctgtctttgattgtgttctgattccaatgcgaaagcgaaatgaatatgaaaatgagctgctgatagccagaaatgaggcacaggaagctttgcttgccaaacagaaagccaatgcggagttagaaattgccttggaaacgctgaaagcaaaacaagaagaacttcttgagatcaacaaacaaaatcaacaatttaaattaaacaccaaaagagagcttgaactcgccagaaagatccagaaaaactcgttgactgaaccgattgtaaacgatcaggttcagattgactcttattacaacgcatcgagtgaattgtcaggtgatctttacggatattatcaaatcgatgaacaccgttacggcattattatccttgatgtgatggggcacggaatttcatctgcattgattacgatgtctcttcatcctttgttccagcgccagatcacgcaaggtctcagccccgttaaagttatgaaggaattggaccggcaccttcacagcttgtttcaaaatgatgaggaagcaagacattattgcactgctatttatctcgagattgacatagcacggcaaagaattgattatgtcaacgcagggcatccgccggcactttggcaggacgatagcggaactcaacatctgcttcacgctacctcgcctccgatcgggatgtttgaagacttagtgtttcagtcaagcagcctttcatatacggagggcggaagattgcttctgtatacggatggcgtgatggatcctacggcttcatgttatttatttgatttactaaaggatcatcctgattcgccgatcgctgacctgaaggagaaaatccttacatcactgcagcatcaaaaggaagctcatcataagagtgatgacgaatgttttatattagttgatgtaaaataaaatgatccatgagacataacaatgatttgttacatctcatggatttttttgtttcagcgtttctttggaatatgtcctgactccgcatattgaaacacctgcaaggaaggcagcgggtgtccattaaaatcaaataaagcttgattatctacagcacttcccccataccacttcccggcgtcttcagggtcgtattcagcagcatagctggacgcccaccctgacccgtatgtttcccataacactttgtttttctctatctgtgtcttcggcccgactggaatccacgcaggctcccagtagaaaacaccaagtcctgctttgcccgtattcgccactgcctccattacatctcttactgcagttgcctggccttgaacagaaattggatatggcagcgtctgcccgctttttggtgctgtatttccatgcccatcgccatcctcagcggtataggtgtacgatgtctccgccaccatgacttttttgccgtacgtgttggcaacagccttcagcacggaggtcaaattttgtaatgtgccatgccagaaaggataataggagctcgcaaacacatcataatccactttgtttttgctgagtgtttccgcaataaatggataccttccagccgtttctggattggtaaaatgcagggcgaccaaaatatttgaatttgtctccctgaccgctcggcttccttcattaaataattggcacatcttcgtccaatcagtctcaccggcaaatcctcctgttgtttcatttccgacctgaaccatgccgatgtcaacgccttccttgatcatcttttgcaggctttgtttcgtatactcatagagctttgctttttttgcttcaaagctgagattcacccaggctttgggcaccttttgtttcgctggatcggcccagaaatcagagtagtgaaagtcggccagcaccttcattccgttcgctgtcgctctttttccgatttcgatggctttttgaacatcattgtttcccccgccatacccattgccatttgaatcatacgggtgattccagatgcggacgcgaacatagttgaccccagcctgttttaaggttgtaaagatgtcctggcgttttccgcttgtattgtaaaaggtgacaccgctgttttccaaagcaataacgctggatacatctgcccctttgataaaatccttgttcatcccctctacttttttaacaaaaagatcctctacccgaagctctgacacgtgcttctccttctcaatggcagcggcatatcctgttgaactacatgcactccacacgatggcagccgcaaagaacattttcactttgcttttcatgatttcatccccccaagacttagtaagcggtttcattctatagaaaaaagaatccgcccatatcgagcggagcatcagcctaatgtgtgtttacgataattctcacttcatacttttccatcgtcaggtcgcctgacaatatgtctcctgtcatcatgtccttcacactctggtcaaacgtgaccagctgtttttcttccgtgaaattcatgacaaaaatataatcattgtcctgatcctgcctcgcttgtacggagacgccttttccgtgccgaaccggaaaaactggagaaagagacaggtctgtgatcagaccctcatagaaatcacgctgaaattgatcctccaaacgcgcgccgataaaatacgccttgccctgctgatactcatggcttgtgaccgctggcgtgcgcgcataaaaatcttcttgatacaccgcttccactgaagcagtctttacatcaatcacagttgcataatccttcatttcatatatttggctgcggtagctgacagcgtttcgatccttcggatacagggtgtccgtttcaagaggctcaactccaaatatagcttgaagatccggatgccatccgcctgtgtatgttaagtcatgctcattcacaaccccgctgatatacgtcatgactaaggtgccgccgtcagccgtaaacgcttttaaacgggaaatggtgtcctcgctgattaaatacagcatcgggacgatcagcagtttatatggtgaaaagtcttgttctttcgtgatgacgtcgacagggatatcgtgttcccagaatgtgcggtaatgctgctgaagcgtttgcggataacgttttgtcgccttcgcaaacccctgagcatcctcgagcgcccaatgattttcccagtcatataaaatcgcggtttgagccggcctcttcgttccgacaacttcggacagccgttccaatgtctcgcctaccttggccacttcttgaaagacgcggttcttcgggctattgtcatgatccacaaccgctccgtgtaatttttctgatgacccccgtgatttgcggtattggaaatagagaacgctgtccgagccgtgggcaatcatttgcatggatgacagcagattcatgcccgggcgctttgccttgttgacgttatgccaattgaccgcgcttggcgtacactccattaataagaaaggctgctgcttcaagcttcggtacagatcattgataaagccgaccttcatcgccaaatcagctgtgctttcccagtcattgtgccagacaggataagcgtcccagctgatgacatcgacatgctttgcaaatttgctgtagtcgaggccctgatacgggatcaaatccgctgtgtcagccataaaattcgttgtgatagggatatcaggcgtcaattctttcagcggaatgatttcatttttataaaacgaaatcgtttgatcggtgacgaaccggcgccaatctaaattcaggccatgcaagccattttcaccgatcggcgaagggctttcaatttgtgaccagtcattgaacgtatggctccaaaaaggagtccaccacgcctggttcaatgtcttgaggctgttgtcatatttcgatttcagccactcccggaaagcatgctggcatagatcacagtggcaatctcccccgtattcgtttgaaatgtgccacattaacagcgccgggtgatgtccgtatcgttctgctaataagcggttgatgtgccgtgttttttctcggtagactttagatgtgaggcagtggttgtgccttccgccgtgcagctgtttgacgcgggaggcattgacgcgcaaaacttccggataggtttgcgacagccaggccggacgggctccgctcggcgttgctaatatgacccgaccgcctatactgtgaatccgctcaaaaatatcatccagccattcaaattgatatatgccctcctccggctcaagtgcgctccatgcaaaaatgccgacagaaaacgtattcgtatgagaaagcttcatcagtttgatatcgtcagctaaaatatcgggccgattcagccactgatcggggttgtagtctcccccatggagcataaatttcgcttctgttacgtgcgttttttcaagctttgacatcacattctcctccttgttctcttagcccttcgttccgcctgcggttaatccggatacaaaattcttttgcagcatgataaagataacggcaaccggtatgctgataagcagggctccggccgcaaatgtcgtatagctggcccccatgacatcattcactaaattgaatagaccgacgggcaatgtatatgattcaggcgttctcaatatggttgaggacagcacaaaatctccgagcggaccggtaaagccgttcatggccacgactgccgccatcggttttgataatggcagaatgatctggaagaaaattctggtgctgctggctccgtcaatcttggcgctttcgtctaaatccatcggaatggaatccatgtaccctttcatcaaatacgtattcatcgggatcaagccgccgatataaagcaagattagcagccaatggctattgatcattcccaagatttgcgccagcacaaacaaggcaattaaagctgaaaactgaggaatcatctgcagcaataaaaagagcgttaaagcgtatttcctgcctttgaagcgaaagcgcgaaaacgcataggctgtaaacgtcacacagagcaaagaccctgccattgtaaacaggctgatcttcattgagttgacataccactgcacatattgaaggctttctttgcccgcaaataattccttgtaatggtcgaatgtcggatgcttcggaatgatggatgtactgattaagctgttgccagggttaaagcttgcgcctgctgtccaaaggagaggataaacaatgatgaccgccataaaggctagcaacaagtaagagaaaaggagacggatatattttctgaccttcatatctgccagcatgccttatgcctcctctttaaaagactttgtctgtctgaactgccacaatgcgatggagataacaaatacagataataaaatggttaaagccgcagcaagtgaatattggcttgactgcattgtcaatttataaatccatgaaacgaggatatctgtcccgccggctgttgatccggttacagccggacctccgccattgaatagatagataatattaaagttattaaagttaaacgtaaactgagtaatgataatcggagccattgcaatgaacaccatcggaagcgtgatgtatctcagctttgaaaagacagaagcgccatcaatcgtagctgcttcatacagatcgtccgggatggattgcaatacgcctgttgagacgagaaagatgtacggaaatccgagccagccctgcatgagaatcaacgcaagcctcgaccaattggcatctgtcatccacggaagcggatctatcccaaagaaagccaagatgtcgtgattcatcgcaccgaagctatcattaaacagtcccgcaaaaattaaaatcgtcacaaaaccgggaacggcccatggcaaaatcagaatcgtccgaaaaaaacgtttaaaccgaaggtctttctggttaacaatgatcgcgagaaaaatccccaagctgacttgcagtgtggatgcagcaagtgtccaaaccaccgtccaagccagtacatcaaaaaaagtcgacctccaaatatcaactgtgaaaatatttgcgaacgtttgaaaaccgacccaatcaattaattttgcaggaggagaatgatacaaatcatagtttgtaaacgctaatgcaaagctgaataagataggaaagatcacggcgaaaattaaaataaacaaagatgggccgctgacgacataaggatagccctcagaaatgatatgttggtattgttcctttaaggaacttaatggcttattttcatcacgttgttttccgctttggaacgcatcgcgaagattcacataatacaccgcaaggccaaagcaggtcacgatgacagcaataattccttccgccagcagaaaaacggaattatcccgcggcacttctgttcccagtgtaaagattccccaaaaccccatattgagcagatctccaaagaccgcaaaaaacgatgcgcctaagaaaagaaagacaataccttttatccattgcttgttataaaattgcccgagccccgggatgatagaaagcaacaaagcgacttgacgatgctgcaccgttttcacctctcttacaatacaaatctagcttcctctttattttccgctgtgctttgccttaatttgtcctttggcggtttcagcggcttgatccaatgcttgtttcggatccgccttccctgttgcaaccgtctgtaatgctgaatcagccggcgtccatatttcattcatttccggaatatttggtgttggctctgagaaacgggattgttcagtaacagcccgtgccgcctcgcttttcataatagccgggtcattggctagggatttcacagcaggaacttctttcgtctcttcatatcgtgttttagaatttttttcatttgccaggaaaacggctaattcttgcgccagctctgcattctttgaaaatgcactgacgttgtagcttttgacgccgataaaggagctcatgtttttcccattttccagcttcggcagtttcgtaatgccataattgattcctgctttcgaaaaggcttctacattccatggaccagaaataattgcggcggcttttccttctgtgaacagcgattccaatacgttaatcccttgttctccaataatgccagccgggaacaagccatctttgtaaaacttctgaatcagcgccgcacctttgacagctccttcattattgattccaatgtctgacgggttatagctcccatctttggcctttccaaaaatgtatccgccatatccgctcatcacactttctgcataataaatttgatcgaatagggctaaaaagccaaatttgctgccgtcagcagtctttttggaatagtcgtaccactcttccagcgttttgggcaattccttttcggagatgagatctttgttgtaaaaaaggacagtcgtttcgaccgcttttggcagtccataaagcttttgatctaccatttgagactgaatggaagcgtcagtataaagtgattgaacgtcttttttgacatgtaattccttgagtaatccttccgtgacagcggttccgatttggtctcctggcattgttaacacgtcagggcctgtgccggccggtccgtccattcgcaaatcttcaatctgcttggcatacggtttttcaacgactttgaccttcacatcatgctctttttcaaacgcagcaacggcggctttaatgccgatgctcttttctttatcctcccatacaacaagctctgatcctttcgaactcgatttggcgctgctgctttcctttgggccgcaagccgccaaggataaactgacagctgcgcagagcatgaatacggaacacttttttgccattttcattgattgtcaccctttcggtaggaatgaaagcgctttaaagataatatagcacgcctgagaaaatgtgtaaacaaactatttacttcatagagtaaatttttttacctaaataaaaaatgacttagtgtcctaagtcatccttaattcatactcttcctgacgattaattctgcgcccacatataatgtttttaccgttcttctcttgtcctgcacttgttcaagcagtaattgaacagcatttttacataattcatgtatatcaatatgaaacgtcgtcagaggaggcgagacatacttcgcgaagctgatgttattgatactcacaatgcttaccctgtttggtatggcaattcctttttcgttcagggcttgcagacagcccactgcaatcgggtccgctgcaatcataaaagcagtcggaagctgatcgcctaatgtgtcgatcgctgctgacatcaggcggtagccgttttctacagagaatccgcgatgacagaaaatatagcgctcgtccagcatggctttttccctcatataggatctgaaggtttgttcacggatgtccatttcatcctgattggtattcggatttttgtaagtgccgccgataaaaccgatgctcttatgccccttctcagtcaggatgtttaccgtcttccttgtcatttgtgccaaatcgggccttaccgagtcaaaatgatcgggatcaggagttgaatcgatgaacacgccgttttcagtgagatttctgaggaaagccagctcttcatctgaaaatgtgccgacggcaataaacccttccgtatgttctggaatgctctcgattccatccgctattttataagtggtcatatcgacattgaatgctttcgccagtttctctacttctaatctcatcgttttaaaatagacatcttctaattcttctttatctgtcagccaatataaaaacgcaatatgtttcaccagcggccttactgtttttttgcggtaattgagcttttccgccgcttcatagattttctcccgtgtctcatcaggaacagaaaggctttcatcgttatttaaaacgcgggaaacggttgagattgaaaatcccgcttcctgcgcgatatctttaattgtcgccattgcatctgcctccattattcagctcgcattgttttagtaaaatattttactttctttttcgcaaatgtcaagtgcacaaagccctctggctgcctcatgtaaaaagactgaaccatttgcggctcagtctcagttgttcgtatcattcggaaccggcggaattgcccgggaaatgagttggttattgcacattttcctcgaaatatcccgaaagcacatcttccacattcgtcaaatgcgccagcatggcggcttccgcctgtgcaccgttcccggcagccacagcattgtaaatccgttcgtgctcctcatacagccgctgaacggaggtcttcttggaaaacagccagattttcctcgtttccctcattgtttccagcagcaatgatgacacgtgattcatcaagtgtttaagaagttcattttgagaagcgtccgcaagcgcaagatgaaatgcaaagtctgctttctctcccagctccccgtccgcttcaatgctgcccatttccttcagtgcatcctgaattctttcgagatctgcttctgtccttttttcagccgctagtgaagccacgccgatttcaagcagttttctgacctcgagcagctgcttgacgtcctcttttttcatcagaagggcggctgagagcggctgagaaatttgattgagctcaaattccttcagatacgtgccttctccctgtttcatttcgacaagccccatcgcttttagcgcagaaagtgcctcgcgaaccgctgaacggctgacttgaaagctctcagcaagcgcctgaacagagtccagtttatccccggcttcaattcgccgtttttgatcatatctaatagtgcatccgctacttcttcatatatttttttgttttaatctgtttgtatttcaatgcaattcaccccgtaacttgtaggtctggctgtttacgatctattatactctgttttgtgggccgccaaaagattttgactattttgtcaaaaagtcttgtactttgatttttttcaaaatataatgctaggtaactggtcttattacccagtcatcagatgatcatatcatctatagaaaccgcttacatatggcgccagtttatgtttcaaggaggggtttgggatgcaatggacacaggcatatacgcctatagggggaaatttgctattatcagcgcttgccgcacttgtaccgattattttctttttttgggcactcgcgattaaacggatgaaggggtatacagcaggcttggccacattggggatcgcccttatcattgctgtattggtttatcggatgccggcggaaaaagcgctgatgtccgcgacacaaggagccgtatacggattgttgccgatcggctggatcattgtgacgtctgtttttttgtataaaatcactgtgaaaacgggacagtttgatatcattcgcagctctgttctctcgattactgatgaccgacggcttcaggctctcttgatcgctttttcattcggggcttttttagaaggggcagcaggcttcggagcgccggtcgccatttctgccgcgctgctggtcggtctcggctttaatcctctttatgctgcggggatctgtttgatcgccaatacggcgccggttgcctttggggcgattgggattccaattacagccgtagaagggccgacagggattccggcgatggagatttcgcaaatggtcgggcggcagctgccgtttttatccgtatttattcctctttatttaatcatcatcatgagcgggttcaggaaagccttggaggtctggccggcgattctcgtatctggtgtttcctttgctgttgttcaatatctcagttccaattttttagggcctgagctgcccgatgttttgtcagctcttgtttcaatggctgcacttgctgtgtttttgaaatggtggaagccgaaaacaacattccggtttgccggtgaacaagagtcggccgcctcaattgaaacggcgcgcacaaatccggcggcgcctgcgtacagcggcggacagatttttaaggcttggtcgccatttctgctgctgacggcgatgatttccgtatggggcattccatctgtcaaatctgcactaaccgggcattatgaaggctctgcggtgttcttgaagtggctgaatgctgttggagaaaaactgacttttgcccccggtgtgccttttttgaacaatcagattgtcaatgctgacggtacgccgattgaggcggtttacaagcttgaggtgcttggttcagccggcaccgcgatattgattgccgcagtgctgtcaaagttcatcacggcgatttcgtggaaagactggggaaccgtttttaaagaaacagtccaggaattgaagcttccgattttgaccatcgcttctgtcgttggttttgcctatgtcaccaactcctcgggaatgagcacgacactcgggatgacactcgcgctgacaggttcgatgtttaccttcttttcgcccgtcctcggctggctcggcgtcttcattaccggctcggatacttccgccaacctgctgttcggcaacctgcagaaagtcaccgcattatcagtcggcatggaccccgttctgtctgtggccgccaattcttcaggcggtgtcacaggaaaaatgatttcaccgcagtcgatagcggtggcatgcgccgcggtaggactcgccggaaaggagtcagatcttttccgctttaccattaaacacagtctgtttttgctgctgctcgtctgtatcatcacctttttgcagcatcacgtattcagctggatgattccttaaaaaaatcctcccgtctagggaggattttatttatatcgctttctcgctgccgatgacggaatattcatttgatcgcgatattttgccacggtgcgtctcgagatttggatgccgtgttgttcatacagcaaatcgacaagcttttgatctgaaagcggttttgttttgtcctcttgattgatcaggtcttccagatgcattttgactgcataattcgacgcatctccctctcctgaagcctcggcttttgctgagaaaaagagtttcatctcaaacagcccgtaaggcgtttgtattgttttccctttaatggcccggctcacagttgattcatgaaggcttagacagtccgccacctctctcagagtcagcggcttcattgcgcttcgccctttcagaaagaaatccttttggcgtgtgatcagttcattgataattctcgtgattgtctgttttcgctgcctcagcgcgcggctcagccagcgccactcctgatatttcgcagataaataggagacagtatcctgacaggagccggatgataaaagcgttctgtactgcggatgcagatcgatctcgggaaacgagcgggtattcagttccgctgcgatgtgcccattttttacggtgataaaaatgtcaggctcaatatacacatcttgctctggccgggcaaacagaaggccaggtctaggatgaagagccgcgatatcatctgagatatcttgaatggtatgaagcggaattcctgtctccactgaaagcgctttccattttttttgtgcaaaagcatcaaaatgagctgaaaccagcatttccgcttgttcatttctgttcggcagccgctgtaattgaagaaggatgcattcctgcaaagatctcgcgccgattccagccggttctaacgactggagttttgccaaaacagcctccgcttccttggccgatacagataatcgccgtgctgcctcctctatatcttcttccaagtacccgtttgaatcaagcgaatgaatcagataattaaaaatctttttttcagtgttggtcagattcatatcgagtgactgctgttttaacgcatcctgcaatgttttttgcggattacttaattgaaggcccgcttcctgtgcattcatcctgtttttgtttgttttatggtaagatagtggcggtgtgtctgtttcctttcgttcaataagagggttttccagtgagagctcatcaatgtactcggcgagttctgccgaatgatagccaagcagcgtgatggcctgcctgagctcctgtgtcagttgaggctttaatacttgtacttgctgaagtttcatatccatcttgctcactcccctttcttcattgtacatgattgagatcacaccgtatacatttatgaaaaaggagctgccaaagaaatgtctgaacttttttccgtcccttattttattgagaatttaaaacagcatattgaaatgaatcagtctgaggataaaatccacgcgatgaacagctactaccgttccgtcgtctcaacactagtgcaggaccagctgacgaaaaacgcagttgtcctgaaacggattcagcatttagatgaagcatacaacaaagtcaaacgtggagaatcaaaataaaccttccgctcacatgtgagcaggaaggttttccttctttgaggtgtgctggatgagacgggtgcttggcacgccttccatccaggtatgaaagtaattggcgtttttcccgtaggaattatcaatgaccgtgttttctttttgaagaagagaagacaggatgtggccgtgcagccttgatgtttccaccgattcgtaacggctgaaaaaccgaatcgctttttggacgatataatccgagtatttttcccatatatacgcaatgggcaaagggttgcctgcttttttattcaagacgttcagcgtttggagaaaagcaatcgtccggcggtctgaagctgacagcaccgtgcgccagtcgtagctttccgcttctgcgtgttcctgaagcgcctggtttgcttcatgatctgttcggataaatctcagcttttgattggacggctgctgcgtgggaatgacgggaaacagctgatgagccatatcaggcagaagctgaatgtgatttgttgtaaaataggcctgtgccgtagcataggaggctttttctcttgtcatgatgtgaaggttcgcatgcttagaaaatatctctgccgtccgtttgaggttgtctttgttttgaaaataaatcgattgcggcaggatcacaattttgtggttcggataggtttgaacgattttctctctaaagccttgatagtacggatacagatccccgaagtttccgcctccctggcagacgatgatgagattcggatcaagctttcgcccgattgggaaattgtctggattccagcgttttctgacccgaatcccgtgttctttaaagaaggcttctgttcctttcataataaataaatcccctacattcccatatagaggatagtcagcatatataatctctgattgtttcggaatgacgtcgagcagcccggacagtttctgttttaggctgatcatcgaatgcttgctgtccatttcttcacctcggcagtttggaataagtgcagtagcacttcaatgacccggtcttgctcatcttctgtcatattggaccccgatgggagacagattcctcgcttgaacaaatcttcgcatacgcttcctgtatcttcatgagaataaaataaagccggattgaacagcggctgggtatggagcggcttccacagcggacgggcttcaatgttttcttcagcaagacgttgaactatgtcatatgggctgagcccgttatcaagtgtgagcgtggtgagccagcgattggatacgcctgctgcgtactctggcataaagcggacgccgtctaagtgaccgagcgcatttttgtatctcgtgaaaatggtccttcttttctccactcgctcatccagcacctcaagctgggcaatgccgacgccggctaagatattgctcagcctgtaattatgccccatttcactgtgttgataatgaacagccggctctcgtgcctgcgaagcgagaaatcttgctttttccattgcggcttcatcatttgaaacgagcattcctccgcctgatgtggtgatgattttgttcccattaaatgaaaaaatgccgaagcgcccgaacgttccgctttgcttccctttatagactgtgccgagagattcggctgcgtcctcaatgacaggaactccgtatgcatcacacaggcttacgatttcatccattttcgcgctctgtccatatagattgacggcaataaccgcttttggcagtgttccgtttcttttcgcttcctccaatgctctttcaagggctgtcggcgacatattccacgtatcaggctcagaatcaataaagacgggcaccgctttttcatataaaatcggattggcggttgctacaaatgtgaaggactggcaaaacacgctgtcaccttcttttacctcaagcaaacgcagggccagatgaatcgccgccgttccagagctgaccgcagctgctgcttttacaccgactcgttctgccagctgttcttcaaatgaattcacgagcggcccaagcggcgcgatccagtttgagcgaaaggcttctgaaatatagtgctgctccctgccgctcatatgaggggagataagtagatttttttatgcatagaatcatcctttgtttgatgtttgaatggaagaaatgatgcgtgccggagcaccggccgccgttaccctgtccggtatgggacggatcaccgcggagccggcgccgacaatgctccaagccccgattgtgatctgcggtatgacggatgcaccagttccgacgtgagcgccttcctgaacggaaaccgctcctgacagcgtgacacgcggggacagatgaacgtaatcgctgatttgattgtcgtgctctgccactgcacccgtattgatgatgcaatgagcgccgatgcgcgcatccgcctgaatgatcgcgcccgccataatcactgtcccttccccgatgacagccgacttgctgacgatggctgacgggtgaatcaatgtaataaaatcatctttcctcagtcccagtcgcaccgccagctgttttctgacactgttattcccaacagcaatcagaaacagcacatccggaatgagcctgcgcagttcagtaacggcttccggcggtcctgtgtaccattcttttccgccttcgaacgttttgaatttatcatccagcaccgcggctaagcgcgtatctgagcgggcgtttatcagctctctgatcacctttccgtgtccgccgtcacccacaatggccacgtttttcatgaggacacatctccgcttccggtaaaccgttccgcggtcacatgattggtttgctgaatcccttctgaaacaaggacctttcgcaccgtcaaacataaaattttcaaatcgagaaaaaatgaccggttgtcaacgtaccatacatctaattcaaatttcttttcccaggaaatcgcgtttctgccattgatttgcgcccagcctgtgatacccggcttcacctcatggcgccgtgcctgtttttctgtataaagaggcagatagtccatcaaaagcggccgcggcccgacaaggctaagatcgcccttcaggacattcaggagctgcggaagctcatcaatgctcagctttctgatcagcctgcccgttttcgtcagccggacttcatctggcagcagatttccctcactgtcccgttcatccgtcattgtccggaacttatatagggtgaacggtttgccgtgcaggcctggccttacttgcttaaagaagacaggtgatcctattttcagcctgacaacggcgatggtgaacagaatgatcacactcgtacagcacaacaaaaaaatggcggccgtcagatcaaaaagtcgtttcaggatcaaagattcacagctcctttcgtttttcgaaaccgttttagtatcagctgtctttcctcttttgtacaaacgagcataaaagcgaaaacagcgtagcaaaagctgactgtcactcccgtcgctatcagtgacggccagctgtcaatcttcacaacgaactgaattgccttacagaccgtccaggcaaatacagcggctgaaagaggcccgattatgcctttaaagaacacgtgctttttgtagcctgtaatgcgggatacgtaaagcggcgtaaagatggcattttttaaaataagagaaatggcccctgccaatgttatgccgtacagaccgagatgagccggcccgctcagcgtgaccgccagcaccacattcaccgcacctaacagcagggtaacaatcgccggtgttttttgttgattaaaagcggtccatatataaaacagcggcataaaggcgaggctgacaaccaagtatccggcatgaataaataaaagcggtgctatcgttgaaaaggacggtccgagccagattgtcagaaaaggtcccgccaatccgcccaataaggcagcaggaagtgcaagcaaaagaccattgagccttactgccttattggcgtaattcatcaatccttccatatcgccttttgaataatatgaagtcatgatgggcgcaaacagggatgcgaccgttccggccaagctgcgcaaaagcagcggaaactggataatcgccgcgtatttcccggatgcagacgcccccagcatcaaattggcggttaacagatcaatctgcaaaaaaagcaggacgccgatttgattgacggagctccatgcgcccgcttgaaacagctccttgcttgtacggaatgaaagatccttcatacgaaacgaaaaccacggaatcagctttttgaagaaatagaaagacagcacagacgcaataacagcaccagctaaagctgcaagctggatctgccagattttcggcgcaaagcatgcaaacaggagcagcacagacagcacccgtataagcatttgcaccgcctgaatggaactggtgatataaaggcggttggcataaaatggtgcagcgccgaagcccgccatcagaaacgttaaaataaacagcaaactgccgattaaaatcgacaaacgcacatcagccaaaagcgcttgcggcacattcatgacgcggtcaataaaaaaagccgaacccgcaagcggcagcaagagcagcaatgaaatcaaaacagaggccgctaaataattgctgatatacgcatttgctttctcccgctctcccctgtgggcagcaacagaaaagaaccgaacgacaaccgagctgagcgccacggtaataatcgaaaagtaattaatcacattttgtgtcaagtgaacaaagccaaacgcttccacaccgagcgttttgacaataaaaggcgtcatccaaaccgataggaaaacggacaagagaaaagccgtgagattagcgctgaagtttattgtgaatttcatgcttgcttcgcactgcctttcattatcccccgatgctcgaaaaacagcttgatgagaaaagtgagccgccatttacacagtgctaataccaagcgctctcctcttaataatttctcatgctgaaacggtgtatgtctgacagcctgccgcaccatgtcataggataaaatctgtctgatcttctttttgatgtctttcggcgaattcggagaagcacaggcatttgccaaaagcatcggaagctggtgcctgcaaatgtacacattcaaatcttcttggcatgcgcctgctaagccatagtgattgtagaatgcgattttagcttgatattgtttttgaagatgttcatccatcgccggcttataagggatttctgtcaggctgttcgggttttcacgataaatgtacaatccctcatcaagcattttcacccgctccgcttcgcaaaaagcggacaaattgaagggagagtcttcagcaaaacggatgtcttcatcaaacatcagattcgccctatcaaaaagctcacggcggtaaagataacgccatacataccagataaatctcgtttcgtgagcatgtttaagccgttcagtcatttctcgttttgtcagcacgcggtttgcctcaagatgcggcggcacatatgtccgcctgtccgatgactgtttgtaaaaaccgcatccgacgatgtcgagccgattttcctccgcttcttcagccagtctctggaacatggaggaagatacataatcgtctccgtctacaaagccgatgtaagtgccccgcgcggcctttattcccgtatttcgcgctgaactaagcccgccgtttgcctgatgaatgacccagattctcgcatcccgttttgcatagtcctctgcaatctcgcctgaacgatccggtgttccgtcattcacgaggatgatttcaatatcagaaagcgtttgacgaagcaaagaatcaatgcactcccctataaatggttcaacattatacatcgggacaataatgctgacgagcggggtcattgcgcttcaccgctgattttgtcacgcagacctttaaaatacacatctctcggaaagcctgcacgggatgtttcttttgttaaaagctcattgactgcggctgttacgcgctctggctccggatgttctatcagcttcatgaacgggatgtctttaagccattgatagccctccatcaccttatggtcaaaggagcgaatgacaacacacggcgttcctgtcagcgcgcaaaaaatcatgccatgaagcctgtcagtgacgacggcttctgcgctttgcagcttagaccacagcgcttcaagctcatgttcgcgtgtatcgcggctgacccggcggccgatcgttgtcttaaaggatttgatctcgccgaattcctcacatagcgcagccttgacccggttcctctgctcctcctgaagcacgctttcctgatcctcgcgcaaacacatataaaccccttcgcgttctgcgggggccttgcttctgtctaaatacagcaccatgtccggctgcttcaaaattgttttttcttgaaaatgctgtttcataaattgatacgttgtttcatcccgcgccatcagcaacaggccggggtgcgcattataaattttctgtgcccgtttcagctctttgcgcccttttttcgtgtcagaaaaatgagccgttgccggaagctggacaacccgatagtcatggaatgttttaatgatgaagcggcgcgtccactcctcataacggtataaatcccccatatttccgccgccgatgataaagaccatatcctccggatggcgcgagcggatcaggttttttgctgatttgtaaatgtccttcatatcgacctcgacgatgtcaaagtccgggtattcttgctcaagaaatgccttgctggcataagcaattgcgtgatctcccaaattgtcatgggacggcagcagggtcagtatgatttttttctgatgtgctgcggcctttaccggttgatctgccgctcccagccaatattgggacgggtatttgacctttagcagcagccattctgcaaaattgattttcaacgattgtaacgacatgtcctcaccctctgtttctcattttgtactcgatcacccgctgatacacagccgatgccatagcgacgaacggaatcattctgtatttcgccatcagaagaaggcatgaccgttttgcgtcaaaaggagcagtacccgtttttgaaagactttcttgaaacaccgggtccgcgcatatcacgccaacatttctaagcttttcaaacagccggcggcttccgctcgttttccattcattcagcatacagatgctgctgtgaagaacgataaaggtatcaagctccttgcgatactcctccagtttgttgttctcctgtaaaaacgccgcattcgcctcatacagcgcaagtcctgattcaaacaattttttctgatagcgctgcacaatggaggaaaggtgaattcggtaatgatagagcggcgtttttacgtaggctactgagcgggcgaaaaaatgagccctgaagctgaaaaactgatcctcgacatgctccagctcgcctcggagcggaaacgacagccgatgggcttcaatcatgcttcttctgtacagtttgttccatgaaaaccctctgaccttcccttcgaataacgccttgatatagtgctccttcggttgatcctgataggtttgggcaatgtcagagtccatggttttgccagtgtcctcaaactctgcggcgtaattgcaaatgaccagatcagtttcatcgcctgctgcccggagcatctgctcgcaataatcaggctcaatccaatcgtctgaatcgataaacgcgataaattcgccgcgtgctgcctcaatgcctttattccgaaccgcaccgagaccctggttctcttgatgaatcaccttgaacctgttgtccatattggcgtattcttctgcaatatccgggcttgcgtctgctgaaccgtcattaacaatgatgatttctatattgtccactgtctggttccgcagtgattcgagacacgttctgatatatgtttctgtgttataaacagcgactaacagactaaccgcaggtgtttccataatgaccggctcctcttgcataaattaccgggaaaaaatcgttctgtaaggcagaacggatgaatcaaccggcataagcaaataactgtaaagaaaataacaaacaacaatagcgatatagataagggcgttcgatttttcatcaaatatccttacaaaataagggactaagatcatttgatacagaccgaaataaatattgaatctggcaaaaatcacgtcctttgtggccaaaaggccgaacaaaaaaccaagcaggcacaaattgactacaatatcgatttgcggccacagactccgcaatcgttctttatagcaaaatgcaaggaacagcggcagaaccaacacagcgattttgatcacattcattccatttgtgttcgtcatgagccatttttcataatggctgtatgagctgttttcaagtacaacgacaaacacagaaataaatttttgatataaaaatgtcatgccgagaaataaagcggataggccgaatatcgccggtgaccaggcttttcttctgacaataaagtacactggaatcataatcagcgccgacgaatgaaagagagagctgaccagcacaatcaggaaatatcgcttccagttcccgctgatgatataacggatcgcccaaaacaaagcagctgcgaccatatattgcctgatgccgttaaaagacgcgtagtaatgaaaggttcccaaaaacaaaaagacactcagctcaaacggcctgccatagtcggcgagtgtcttcataataaagctgtaggtcacgaccgccaccgtaaaatacatgatttgaggatcttccgtgatgaaattcatcagccaaaggagtgcggtaaaccccggatctgtcgctgttttcgcagtgccgaaaccgaatatctgccacacattttgataatcgcccgccaattcgtacagcagcgtgtacgtctgaaaatccgtgccgactcgatagcggagacctgacacgagcacaagtgaagcgagcggaatccagatcaaaagcttattcggccgataccccgtggcaagcgaatcgtcacggccgccgcacattttagcgaaccaagaccaaataaatacaatccccatattgacggcatatacaatcatcggtcatggtccttttccgtgctgatgttgtatacattcagcagcgctcctacattttgctgtgcatcgtagccaagttgagcgagtgtttctttgatgaactcacgcttcggcctgcctgcggcggccgcccttgcaatggtttcagcccagacgctgatcggctcagaaagacttaatcttgtgacaagcccgagaccggcgtcgactttttctgtaatgctgtctgaaatgatgcatggaagccccgacgcctgtgcttccacaagcacaaccggcaagccttcgtacagagacggcatgacaaatacatcaaatgtgcgcatcaattcatggatccgttcttccgtgcctaaaaagaggacgtctgaaagcaaattctgctgccgcgcctcctcctctatctccccgcgcaacggcccgtctcccgccagaacgagctgaaagcgaacgcctctttctttgagatgtgcggcaagtttaagcaggaacgcgtggtttttcacttcatgaaaccgggccacatggccaatgatgagccggtcggctgcaatgccgcgtgctgctttttcttcatcagccgcctgcccatttggggcgaacaactcaaggtcaatcccattcggaagaaggtgaacacgctcccgctccatattggactgtccaaataaaaacctgcccgcatcctctccgcaggcacacagcgctgtcgcattcgccaagatgagccgcctgaacaccatcagctgcaagcgatccttccaattgaagccggtcttccaagacgtattgtgggaatggcataccctgaccggcactccggcgagccttgccgcaagggcgataaagcccgtttggaaatccgtgtgcgcatgaacggcgctgaacggcccgttttcttttatcgcgtttctcacattcctcacaaatgtaaggggattgctttgcccaatgctcgggacataaaaaagccgcccgcctaaagataaaatctcttcatcataagcgcacggatcatttcgatacgttaaaaagtcaaattgcactttgcttttgtccatcttccgatataaattcattaccatggtttccgcgccgcccctgttcatgccgctgagaacatggagcacgcgcttttggctgctattcatgcttgacaagcccttccttttggttcatcactctttttttgtggtagcgattcatcacggctgcaggcataaacgcgcggattaacggttttgcgatatatatgtaatcagataaaggaagcttcaagcgtctgcacgcctgatagacaagaatggcattgtcgattgaatacgtaaatgaccgccgtttgaatgcatcgctgtcttccctcactttatacaaggcttcctgaagattatagcccctgaagccctcttcaaaaaagcgaagccacaaatcaatatcttccattcgtctcgttcgccgcaccgaccgatagcctttcagcgtgcggtaggaactcgctctcatcataatcgtgccgtggcaaaatggggtcccttttgccatgatgcccggctccggaacagaaggcagaatgcgggtgcctcttacgccaaattcatcaaacacaagcatgccggtgccaaccacctgatagtgtcggtgcttttctaaaaacgcgacctgcttttccaggcggcgcgggaacgaaagatcatctccgtcttgacgtgcgatataatctcctgtcgcatgcgaaagacaatgatttaatgatgcggcaagccgcttgtttgttttgttttgaatcagtttgatgcggtcgctgtaatgagcggcatactgcttcgcgatacggagcgtgccgtctgttgacgcatcatcgcacaaaatcagctcccaatttttataggattggctgagaatggattctatgctttctgccaaagtgcgttcgcaattataaatgcccataatgacagaaactttcggtcctgagttcatacgcttttctcctttgtatccatatccatgtacgcggaataaatatctgccatttcttccaccgttcgcgcctccgagaagcgcaaggctgtttttcggccttcctgtcccagctttcggcagagctccggcttatggtaaagctgttcaatccggcgggcaaaagcagcactgtcaccgattttgatcagaaaaccgttttctccgtcgcggatgatttcccgatgcccgcgattatctgtggcgatcgccggtttttctgccgccattccctcaagcacattcatgccgaggccctctctaatgctggatgcgacagatatatccgcaagctgaatcagctcatgtatgtcgctgcaaaagccgtaaaaacagacattggcggaagcgccaagcttttcagccaacgtttgatacgtttgttccattgccccttccccggcaaacacaaggcgaagcgagggaattttttcttttagcaaggctgcggcttcaattaacagcttctggtttttgttcagattgagctcagccggataaaccaatataaaatcatcttcacggaatccgtgcttttctctgagtctttgctgctctatcggactgacaggccggaaacgctcggtattgacgccaatgccgtgaattttctgcgtccttccgcccggcctttgaagtcctttcgcccgtttataatcctcttcattaatcgtaatcaggcagtccgtatatgctgaaagccatttctcgaccggatagtaaagaaaccaatttttcattggtgctcctttgcagaagtgaaatccgtgcgctgtgtacagcacctttgttccgcaccgccgtgcctgcctcgccgccagtctggcgagaacaccgccgaccggtgtatggcaatggacaatatcgtattcataggtgtcgatcactttcttcagctgcctataaacggccaggttctgagggttaaaaggtgacctgcgaatcgggatggagaatttctcatccacatacggcagcttggtttgtccgttcgcggcgacatgaacctcccagcccatttgcttgaaccatttaaaataagggaggtgaaaggccttaaaatgataatcaacagtcgcgcaaaacaatatctttttcgtcattttcactcccctaatgaacgctggcagccgtcattttgtctgatgtattgattgccgcaaacagcctcgctctcaggtcggcttccgacagttcagtgaaatcctcgataaagcgcatcagcaccggccagtcgccgtctaccgctttgccgatatgaatttttggaaagacttgttcagcgtggacttcatttttgttcagtaattcttcatacattttttcgcccggacgaatgcctgtgaattcgatcggaacctgctcagtcgtgtagccggacaaatgaatgaggtttttggcaagatccacaatctttacgggctctcccatatcgagaacgaaaatctgacgccctttcgccagtgccccagcctgaatcacaagccttgatgcctcgggaatcgtcatgaaatagcgggtcattgccggatgtgttactgtcaccgggccgcctttttcaatctgttttttgaaaatcggaatgacgctgccgcggctcccgagtacattgccgaagcgaacagcgacaaatttggttctgctgactttcccaagattcataataatcatctctgcgaatcgttttgtcgcccccattacgttggctgggttcaccgctttgtccgatgaaatcagcacgaatgtctctgttcccgacatatcggctgcttccgcgacattttttgttccgataatattgtttttgaccgcctcttcaggattgtgttccattaaaggcacatgcttatgggcagctgcatgatagacaacatgcggctcgtattttttcatcaaggtaaacattttatcgcggtcctgcacatcagcgatttccgtatggaacacaatgtgtttgccgaatcgtccgttcagctctgtataaatcgaatgaatgctgttttccccatggccgagcagaataatttccttaggctgaaacgcgctgatctgacggcagatttccgagccgattgatccgcccgctcccgtgacgagaactgtttttcctttgatgcggttcgaaatttcgctagtgtcgagggttaccggctttctgccgagcaagtcctcagcttttacatctctgatttgtccggcagttcgtgtgccaagcagcatttcatcaaaatgaggcataattttaatgcttactcctgttcgcacacattctttatataacacctgaagctcatgggtgcggagtgaaggaatggcaataataatataattaattttgagcttttgcaccgcaggcatgatactttcttttccgccgattacgggcagtcccataatttctaatttatgcttcgtttggtcgtcatcaataaaagcgacaggtatgatatcaggttcatctttcgaaagcagctgcctgaccatcagagtcccacctgagcccgccccgataatcagcgcgcgggacgaggcgcagcgttttttcctgatgctttcgtttaatactctggataaaatacgggtccctccaatagacaaaagctgaagcacccagcacgcggttaacagacggaagaacatcgtatgatacacagcatactgaatgataccggtcacagcggcggaaagcgtaatgcccttaagcaggacaatcagctcgccgagtccggtgtatgtccatacctgtttatactgattgaacaggaaagcacacacatgatagctgaggagcaagctgacagcggtaagcagtaatgctccggagtcataaaattgataggaatcttttaaaaattgatatcctgcaataactgaatttaaaacgaggtaagtatccagcgcaataatcattgacagtcttctccggtaactcaaccttttcccccctaattcttttatcggtttagctgcggcggttttcgtctctccaaaaaatcggcagcagctaaaccgacaatacgtcctatgtatatatcagataagtgggcatttaacccatcctcacgccccgccagcgacgaccagcatctaaggcagcaacttcagctgcccacagcagagccgagtgcctccattgatacaggtcaggagacatcacctttacaaaaactagtaggaatagtgttccgattttttcattttctttttgtttaaaagagcgcctaacagcttcgcattggattgttccagtgcatcttttgctttcagaacggtatcggtttttgtttttccgcttaaaacgacgagcacgctgccgtctgtttgatttgctagaatctgagcatctgcaacagccaaaagcggagggaatcaaagatgacgaggctgaattgttcatagatctcagatattaagtctcccattgcttttgaagacagcagttctgccggatttggcggggtcggcccgcttgtcagtacatataagttatcgatcggcgtcttttgcaccgtcttactgagtgaagcattgccgaccagcacatttgtcagcccggttacattatcaacctgaaacgtctgattgatggtcggctttcttaaatcggcatccaccagcagtactttcttttcctgctgctgcgcaaagacagccgcaagattcgctgcactgaacgatttaccttcaccaggcacagaggaggtgacgaggatagatcgcaagttggtctggacagatgagaactcaatgtttgtccgaatggtgcgatattgttccgcaacaactgatttattgtgtaaaacagatatttgagccaaacctcgccttgctttcttttttctaaagatcactcgcttcactccccgaaatgttttatcccgcgattccgccctttgtggacatcaggaacggagcctaagcatggcaatccggttctctcgctgagctgccgtgcgcttttgcaagtatcatcgagaaaatgcagaaaaaatgccagtgtaatgccgcccatgacagcagcgccaaaagccatgaccatatttcgcagcctggccggcttgatcatcgggctttccgaagccttcgcctctgataatatatgtacgccttgtacattcattctttcatctacttctttttcaaacttgttcactaacgtgttcgcaatctcagctgctttcgccggatcgtgatcctgaacggcaacgttgattatttctgattcattttcactgctggtaaccacttttcctttcagcgaggaagccgattcagataggtgcaattccgccttaacttcttccatcaaggcagtgcttttcataatcgattggaacgtgctgctatactgaagatttcgctggatgtcactgagattcgagttttcttcaccgtctgattcatgaaccagcacctgtgtcgacgcctggtaggtcggtgaaatgaccttaaattgcacaaaacccataataagggtgacgccgattgtgatgagcagaatcagcacgaatctgtgtctgacaatcgcatataattctttgaaactcatattctcattcatgtattcatagccttcagccttccgcggctggcttcccgcgcccctttctgttaatgattggattataaaagaaaacgttattatttaaaaattgcaaaataagccaataagttctctttagagaacaaaaacgtgattttcctctaatttactgcacttcccttattattttaaattttataaagaacgaaaaattccttataatgaacgaaataacgacaggaatagaggagaatttcatattatgattggaagaattatccgtttgtaccgtaaaagaaaaggctattctattaatcagctggctgttgagtcaggcgtatccaaatcctatttaagcaagattgaaagaggcgttcacacgaatccgtccgttcaatttttaaaaaaagtttctgccacactggaagttgaattaacagaattatttgacgcagaaacaatgatgtatgaaaaaatcagcggcggtgaagaagaatggcgcgtccatttagtgcaagccgtacaagccgggatggaaaaggaagaattgttcacttttacgaacaggctaaagaaagaacagcctgaaactgcctcttaccgcaaccgcaaactgacggaatccaatatagaagaatggaaagcgctgatggcggaagcaagagaaatcggcttgactgtccatgaagtcaaatcctttttaaaaacaatgggaagatgatgatcggttaagggctaacgttcgcatctgtagggtaaatctgtttataatgggggaaaaagggagagaacacgatgactcatcaaatagtaacgactcaatacggcaaagtaaagggcacaacggaaaacggcgtacataagtggaaaggaatcccctatgccaagccgcctgtcggacaatggcgttttaaagcacctgagccgcctgaagtgtgggaagatgtccttgatgccacagcgtacggccctatttgcccgcagccgtctgatttgctgtcactgtcgtatactgagctgccccgccagtccgaggattgcttgtttgtcaatgtatttgcgcctgacactccaagccaaaacctgcctgtcatggtttggattcacggaggcgctttttatctcggcgcgggcagtgagccattgtatgacggatcaaaacttgcggcgcagggagaggtcattgtcgttacactgaactatcggctggggccgtttggctttttgcacttgtcttcatttaatgaggcgtattccgataaccttgggcttttagaccaagccgccgcactgaaatgggtgcgagagaatatctcagcgtttggcggtgatcccgataacgtaacagtatttggagaatccgccggcggcatgagcattgccgcgctgcttgctatgcctgcggcaaaaggcctgttccagaaagcgatcatggaaagcggcgcttcccgaacaatgacaaaagaacaagcggcaagcactgcggctgcctttttacaagtccttggaattaatgagagccagctggataaattgcatacggtttctgcggaagatttgctaaaagcggctgatcagcttcggattgcagaaaaagaaaatatctttcagctgttcttccagcccgcccttgatccgaaaacgctccctgctgaaccagaaaaagcgatcgcagaaggggctgcttccggcattccgctattaatcggaacaacccgtgatgaaggatatttatttttcaccccggattcagacgttcattctcaggaaacgcttgatgcagcgctcgagtatttactagggaagccgctggcagagaaagctgccgatttgtatccgcgttctctggaaagccaaattcatatgatgactgatttattattttggcgccctgccgtcgcctatgcatccgcacagtcccattacgcccctgtctggatgtaccggttcgattggcatccggagaaaccgccgtacaataaagcgtttcacgcattagagcttccttttgtctttggaaatcttgacggattagaacgaatggcaaacgcggaggttacggatgaggtgaaacagctttctcactcgatacaatcagcatggatcacattcgccaaaacaggaaacccaagcaccgaagctgtgaattggccggcgtatcaggaagaaacaagagagacgctgattttagattcagagattacgatcgaaaacgatcccgaatctgaaaaaaggcagaaactattccctccaaaaggagaataaacaaggggaaaacaggatacattggtgctgccattgttgtggcagcttgtatcattattttatcggccgtggtatgtttacgggacacagtctattaccagcctatgcgctggactggcatcatactgtttttcacgggaattgtgatggttcccgcatactcagcaaaaagaaaacccggaaaagagaagtaattctcttttccgggtttttatgtttattataatcttcccgcgcgaatatcgtctgtcattccctcataaggagccttcgaaatcacttcttcgttgtcgactccttcatttttcagaaatgtaatttccgcaaattcaggtacaacgtattttggatacgtttcatatttttcgcgggattcttccatcaaatcaatgtggtcattttggtagcaaaccgtaatttcaggatgttcatgcacccatttcgggaagaaaataatgccgtgcatgcgtttttcatttggcataaagtttaatgaaacatccgtgccagtcggctctgtccaagacactttatatacgccttctgtcagtttgacaatattcacttcctgatcccgaacccagcgtccggcaaccattccgctatgaattctataatcaattgtatggtcgtttttaatataaatctcgtattcccagccgttttcatacgtataaatcatgtggcttccgataaagttttccatttttcacactctccttagtcttttactgcacttcataaatgtctagtcgaacgtaatcaggggttctttctgcggaaccgataaacaagcggtcatggagccattgataggcttcactgcctgtttcaaacgtcggtaccgtacgaaaataaacatgctccggatcaatgatttccccggctgccgcttgttttcgaaacggctcgctgacttgccgtattccattgttttcaatgtaaatcagttcatgatctgctgtttcgatcacatacctggcagataaatcggttctgccgtcagcgcgaatcatttgcgaatcggcaccgctcggcaaaatacgtccctttacttccccggttattgttcccgaacgaatcggaatgaatcgtctcagtcccaggcctgtctcaccaatcgtgataggcggatcaaccttgatttctaaagaggcgaatggttttaaaaccggcttcttcacgagaaccacctcaccttcagaaaaaatcatgtaactatttacatgtttaatttaacactattgcagttaactgtcaaacaataggaacataaaaaaacaaggactgtttgaagacagtccttgtctgaagctagctttgatatggaagatatgtgctgacagtgctttttgcaagacaggccgaggaatctataatcggaatctcactttgaatatgatctaacaccgcatttaaatccgtgcaggctgaaatgatgatgtctgcatgctgactgatttcttcatatagcgtctgccacaatgcttgtgtatgctccatatgattaggctgtttgattgcggcgataagctggttcacagcctgctgccaatggtccttgtgaacaacttcttgtccatttgccttcagaactttttggtagatggcggattggatggttggctctgttcctaaaaccaccgctttttttgcaggatgcggaatctcttttatcgtttcctcaacgatatgcaacataggaaccgacaatgcctgctgaatctcttcatagtagacatgcgccgtattacaaggcagcgcaatgaaatccactcctgttttctcgagctttaccgctccgtcgataatcgcttttttcatctcgtcatggtcaattggacgatctgcatagaagggcgtcgggcatgaatagatcatcatgtgcgggtagtcaatatcgtttgaagccccatacagcttctgacagtaatcaatcaccttatcaataaacggcgaggtcgatttcggccccattccggctaatattccgatcatcaaattcattcctttctaattcgtacggaccgcttcttcctctgagccatcctcatagaggataaagcttttcgcagcatcctcacctaacatgaattcaatttcaacagacagtgatcgcagaaagaaacgggtttccgaggaaggaaataactccagtctcagctgcccggtgatctccaaataaagccgttcattctcggctgtcacctgtgcagccgtcccatcctgcaacaggtagctgccaacatagcggctgtatatagccgtatcaattgcttttttctttttatcagcaggacgttccgggacctcatatggctggccaaatagaatatgttccgccgccttcagaatcgcttgttcatattcagtatcctcttccttattactcaaatagatcagcgttttacgatgatcgatatatcggatcatcatcgtcgaatagccgggccatcctccgctgtggctgacaacccgccctttttcaggactgttttgcagtacccagccaaagccataatcaattgtttctccattgttgaggcgcactggagaaaacgcagattccttagaagccttgctgattaaatcgtcctgatataaagcctgatcaaatcgaaacaaatcgcttgtgacagagttcaccgtcccatctccctgtatgccatcgagatacacaacatagttcgtttcctctagctcatcagggaggacgtatgtttcggaatgtacatcatacacatatccatatgcataatgatcaattcgctcaggcgaaagcctcctgttatacactcttgtttcattcatgccggccggtgaaaaaatacttgttttcataaaatccgcatagctcatgccagatgctttttcaatgataaccgccagcagcacataccccgtattgctgtacagccagccttcattcggctcaaaataaccagatagcccctcattcatcagcatatcgacaatatcctgattcaccgcaatcttgtgtgaatcccaattggcaaaaaaccatcccatataatcaggaagccctgacgtatggttcaataaatgccgaatcgttacgccctgatacggaaaaccgggcagccagcgatccactttatcttcatagccaagaatccccttctcctccagcaagatgattcccaatgctgtaaaaggctttgacaaagacgctaactcaaacaaagagttggttttcaacgggcgtttttccgtcatttccgcatagccaaaagagtgatgatataaaatattgccaccctccgcagccagaaccgtcccgttaaactgatgtttttcgcctaatgtctcaaataatgcctgaagatgctttcttttattctgcttcattcctccacctcccatatctctgtacgtaactaacctactaacgtttcaaatattttgaaaacaataaaaaaagctgattaatcctcaaataggaaaaatcaactttaatatagcggtattagatctgcatgaatcaaaaaatcctcttttatgaagtcggagaaggaactctagcggctgcaaaatgggttctcgtagtcgcttgaatgactcctgcggcagtactcctcattgcaactgtcaccgtatctccggcgtttaactgaagaatttccgtaatggctacgacagcggggagattccctgcttgaaattggttatttccgccgcctaccacatcttgattcacgagaaatacgacttctaagttgaagccaacattcgcattcgcttgaaattcaactgatgcattaagagaatacacgcctgctgttctcggggaaaatgtagatgtgccggggttatattcattcgccaaatcaaattggacattttgaaaaagaactccgctggctgcatttgcagcaactgacagattcatattgctggtggctctgaaagcagaaataggctggttcgtcattggtgcgaaggactggttttgttgagctgatggggtatttccatttgtgacacttggtgataaaagaggttccggtcgatcgttcctcttaatccatttagttggccggggctgcataactttttcctccttataagccttacgcttctatcatttgtttgctagttaatacattattatattaatcgttacagacattgaaacggtatctgcccgactgtattcaaaaatagaaatcacagcagcatgttccaaaacagattactgcttttgatccaagaggcatgcttcatcaaggcatcagacgatcttatatgaaagacctcagttagagatcctttttaaaacatcacatatacctgtctttcactattatttagtgaaatgagatattatgatattttctgaattgtgattaaaaaggcaactttatgcccatgcaacagaaactataacaaatacagagaatgaaaagaaacagatagattttttagttctttaggcccgtagtatgcaaatccttttatgattttctatcaaacaaaagaggaaaatagaccagttgcaatccaaacgagagtctaatagaatgaggtcgaaaagtaaatcgagcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagtgcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacgcaagaatggtcaggttcagccacatttacatctgacggaaaaatccgtttattctacactgatttctccggtaaacattacggcaaacaaacactgacaactgcacaagttaacgtatcaacatcagacagctctttgaacatcaacggtgtagaggatcataaatcaatctttgacggcgacggcaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaagcttctgcaaagtgataaaaagcgcactgctgaattagcaaacggcgcactcggcatgatcgagctaaatgatgactacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggctatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatcccatatgaactatataaaagcaggcaaatggctaaccgtattcctaacctttttaggaatattgctgtttatcgacttatttccaaaagaaggacatgaccaaaaaacaaaatcaaaacagaagccggactaccgggcggcatatcattttacgacgccggataaatggaaaaatgaccctcaaaaaccgatctattttgatggcaagtatcattatttctatctatataaccgggattatccaaaaggcaacggcacagaatggcgccatgccgtctcagacgatttggtgcactggaccgatgaaggcgtggcgattccgaaatatacaaacccggacggtgatatttggaccggttccgtcgtggtggataaagagaacacagccggcttcgggaaaaatgcgcttgtcgcgattgtgacacagccctcagccaaagacaaaaaacaggagcaatatttgtggtacagcacagacaaaggaaaatcattcaaattctacagtggcaaccccgttatgcctaatccgggtacagacgatttcagagatccgaaagtcatatgggatgaccaagataacaaatgggtcatggtcatggctgaaggatcaaaaatcggcttttatgaatccgataatcttaaggactggcattacacaagcggattcttcccagaacagacgggaatggtggaatgtcccgacctctacatgatgcgggcaagcgacggaacgaataagtgggttctcggtgccagcgcgaacggcaaaccgtggggcaaaccaaatacgtacgcctactggaccggaagcttcgacggaaaagaattcaaagcggatcagactgaagcccaatggcttgactatggcttcgactggtatggcggtgtgacgttcgaagacagcaaaagcacagatccattagaaaagcggtacgcgcttgcctggatgaacaattgggattatgccaacaacaccccgacaatgaagaacggctttaacggcacagattctgtcatacgcgaactccggctgaaggagcaggatggaacatacagcctcttctcacagccgattgaagctttggagcagctgactgtttcaactgacgaaatagaggatcaggatgtgaacggatcaaaaacactgtcgataacaggtgatacgtaccagcttgatacggatctttcttggtcagagcttaagaatgcaggcgtcaggctcagagaatcagaagaccaaaaacgccatattgatgtcggtattttcgctgaaggcggctatgcttatgtcaatagagcagccacaaatcagcctgacaaaagcaatacctttgtcgaaagcaaagcaccttacgatgtaagcaaacataaggtgcatttgaaaatacttgtcgataaaacaacgatagaagtatttgtaggcgacgggaaaaccgttttttcaaatgaagtcttcccaaagcctgaagataaaggcattacccttttttctgatggcggcacagcctccttcaaaaatatcaccgtgaaacactttgattcgattcatgaataaaaacaggggaagcgcaggctgcctctgtttttttatttggagcggtattctctgttacatattgggcattgtaaggaatataaggctggtttcaaaggaggaagcgaatgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggcttgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgccgaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgccatctcgacaggcggcgtcatgtttgcgtatctcggcctgcatccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggcccgcaattggccgggagttctcattgccgtttaaggatattgcggtcatgctcggattaggctggcttgcaacgcttgtcattttagacgccattctgtctcccggaggaaacgggaatatctttatgaatacgacatcccgccttgtttacgcctgggcgcgtaacggcacattattcggcatattctcaaaggtcaataaagatacggggacaccccgcgcttcgctttggctttcgtttgccctgtccattttctggacacttccctttccttcgtggaacgcgctcgtcaatgtctgttcagtcgcgctcattctttcatatgcgattgcacccatttcttcagctgcgctaagggtcaacgcgaaggacttaaacaggccgttttatttaaagggaatgagcattatcgggccgctttcctttatatttacagcgtttatcgtgtactggtcaggatggaaaacagtctcctggctgctcggttcacagctcgtgatgtttttgatctatctctgtttcagcaaatatacgcctaaagaagatgtcagcctcgctcagcagctgaaatcagcctggtggcttatcgggttttatattatgatgctgatcttttcctacatcggttctttcggacatggtttagggattatcagcaatcccgtcgacctcattttagtcgcgatcggctcacttgcggtttattactgggcaaagtataccgggctcccaaaagccgccattgattacgataaataaagaagcaagaggttttcttgcttctttattctttacaaacatacatacacgcgataaaatgaatgagagtcagtcattactggaggtgttcctcatgccaaaacaaacatcgggtaaatacgaaaaaattttgcaggcggccatagaagtcatttctgaaaaaggcctcgacaaagcttctatttctgatattgtcaaaaaggccggcactgcccaaggaacattctatttgtatttttcatctaaaaatgccctcataccggccattgcagaaaatcttctcacccatacacttgatcaaatcaaaggtaggctgcatggggacgaggatttttggaccgttttagatatattaattgatgagacttttctcattacagaacgccataaggatattattgtcctctgttattccgggcttgcgatcgaccactccatggaaaaatgggaaacgatctatcagccttattattcctggcttgaacaaatcatcaacaaggccattgcaaaccatgaggtaacggaaggaatcaattcaaaatggacggccagaacgattatcaacttggtcgagaatactgcggaacgattctatatcggatttgaacaagatgaaaatgttgaagtgtataaaaaggaaattttcactttcttaaaacggagcttaggtactgcttaaaaaatgactgggtaacaccgctcattttttaatgccctaaaaatgactgacgttcattcataaaatagagaggtgtttcatttgaattgggttcttgtttttattgcagggcttttagaggttgtttgggcctcttccctcaaacatgccgattcgcttttggattggatcatcatttttatcttaatcgcggtcagctttatcctgttgatccgctcttatcaaaaaatcccgatggccgccgcgtacactgtgtttgtgggaatcggaaccgtcggaacatatctgactggaattgttctgggcgaatccttctcagcagcccaaatattctttttagctttattgctggctggcattttaggaatgaaattatttacgaaagaaagcaaatctcagccgggaggtgaacaataatggcatggtttttattagtgattgccggcatagaagaaattatagctgccattgccatgaaatatatagacggaacaagaaaaaaatggccgatcattgtgatgactgttggattcggcttatccttttactgtctttcccaagcgatgatcgtcctgcctgccggagtcgcatatgccgtctggactggcattggaagcattggtgtttcggcggtcgggctcatctggtttaaggagcgatttcagctttcacaggtgatttcactttgccttatcctagccggcgtcatcggcctgcgtcttacgtcatcttcataaaatcaaggcatatacagctgtatatgcctttgccattaagcttcgtgatgtttttgaagatgaagcggcggcgggatgagccagcctttgttttttagcagccttaagtattttgcgccagttgccgctttcgacatatgaaattgcccaaacatcatggcaatatcctcacgaatcgattgccccatcattttgctgcatgtcacaagacctgcagcattttgtgctgccgcggaggccgccacatccggatcgagaaaccgtgcgccaggcggaatatcgttaagatctgctgtcggcggttcaggagaagccggcggcagcgccaccccgttttctttcaggatcgtgctgacctgtttgatttcatcttggcatttctcaatagactcacgaagcagcttcttcaggtcatcatcaccgacatgattcaatagcatttggtaattgccgaccattttattgcccgccatcacataactccacaagccgaatacctcaccgtaatgcatcggttcatcctgcggattcccgcttaaaatacccatgttcatcctcctcgcaaattcaatatcgcacatttcataaactgcccggtaggaggaaaatttatgttccagcgggagagatttatgaaacaaaaaagacaagagtggtgaaatgcaaaaactcttgtctttcctctttttatgttcgcctgctaaacagccttttttctcggtgaggcctgctgagaaaccagttgattctaattttttcataagcttttgagcaatcttcctgtcaaaccctccaacaagaatcttttttcttatcgtttttagagccatgtacagattttttccgtgtaaatattcgatcgtggtaaaaagaaaagtgagataaaaatgggataacgcatgatgaaggttgaaaaatcgaatgattaggacaagagatgttcattcattcatccatacaacagactctagataaacatatactgaatgatagttttaattagaaaggagaaaccagctttggcaaaatatcggatcataacctttgatgggggaggtaccttaggtgctttaagtttacagctgatgaacagactggctaaacaaaatccaacattaataagtcgaactcatgtattttcgggaaattcaatcggttcatttactgcccttgcattagcaagcggaagatctccgaaggaaacacttcagtattttgaggatgaaatcctgcccgcattcagcatttcccggccgggcggacctgttttcaatcaacaattaccatactccggttttataaaagcagtacgaaattttttcccagcagaccttcgtcttaaagatgtaagaaaacgaattgttgtcccatcattcaaattatattctccaaaactggatcgttggactcctgtattatttcacaactttcccggctctccctatttcaatgagaaagtaagtgatgtcatactgcggagcagcggtgctcccgcgacgcaacgggcctatcaaaactatgtggacggatatgtagtagcaacgaatcctagtacagccagtatcgcgtttgcggttggtaaagccaacgtaccactggatcaaattgcggcattatccattggaacaggtgaagccccgactcgtttaagaagagatacgagggggtggggaatggtaagtgcagataacatacgtcctgaaaatctgaagaaccttcctccaaattggggagttcttttggacagatcgcctaatgaacctctactgccatttcttcagatgatctctggcggaaatggttactacgaatccatggtcagcgcgaatcttctgggagatcgcttttttcggctagatccacgaattccaaacttctccaaaacggatcctaccgtgtttcccgctctcattgagattgcgaacaaaaccaatttacaacctgtgattcaatttatagagaagaactggaggaccaaataaatttttattttaaaactattctcacttacatttctaacttaccacttttctctgagaaaagtattctcgaataaaaacaggcaatgggtaaaaggaatttttttcttcttgttttgacaataaagttgtttacaagtgtaatgtctctttggattccaacaagtaaacaacatttttgcaaagtatcagtaagaaccggattttttttaagtgttattcaaagctaataagacaatcgcataatgattgatttgaagtttatttcaaaactcgaaggtttactatgcctcttttttcacacaaaaaagacaagagcggcaaatcgccaaacccttgtctttcctgttgttctattggacgcgctcggagggattcgaacccccgacagacgtggtaccggaaaccaccgctctatccaactgagctacgagcgcagaatgactgcgttatgagaacgtcagcacaactaattatacgataattccattcaaataacaaccctctatttcgagaggccgttttttaaatagacaaagcatcttaattggcaatctgacatacgatggtttgaacccctgtatttttggggaaaatgggaaaaagagacgactttgcatatcaggccagctttttgtttgacctttattgaccaaaaatgtatcatgtaactacatacttacctaaaaggtgaaggaggagcattatgaatttaatacctacagtcattgaacaaacgaaccgcggggaaagagcgtatgacatttattctcgtctattaaaggatcgtatcatcatgcttggatctgcgattgatgacaacgttgcgaactccatcgtgtcacagcttttattcttagcagcagaagaccctgaaaaagaaatttctctttacatcaacagcccgggcggctctattacagccggtatggcgatctatgataccatgcagtttattaagccgaaggtatctacaatttgtatcggtatggctgcgtcaatgggagcgttcctgcttgcagccggcgaaaaaggcaaacgctatgcgcttccaaacagtgaagtcatgattcaccagcctcttggcggtgcgcaaggtcaggcgacagaaattgaaattgccgcgaaacgcattctcttgcttcgcgacaaattaaacaaagtccttgctgaacgtactggccagccgcttgaagtgatcgaacgcgacacagaccgtgataacttcaagtctgctgaagaagcgcttgaatacggcctgattgacaaaattttgactcacacagaagataaaaagtaataatacaacctgcaagagctgcgtctcttgcaggtttttttcattacaaggaattgactcccttaaacactttttattctatactgctcccattcctcatgtaacagctcaagcgtcaaatcattcgtctgcctcacaaccagatcagcaccaagcatcggctgtccttgaccgacaccaaccgcaaacatcccgcagatttgattgcagaaatgcctgcttctgcgtcttctattgcagcgcaatcagcaggggaaacatcgagcatcgctgcagctgttaaaaagatgtcaggatcaggcttccccttcgcaagagccgtcggatcaacaatggcatcaaaatcatcgataattgccaaacgtcttaaaatcttaggagcattgcggcttgaagatgctaacccgatttttatattttcgtttttcaattgacatagaagcctgccaatccccgtaaaagatcttccggcgtcaatttgctgatcagcgtttgataatcgcgatttttccgatgcataagctcttgtttctccgcatttgtatactttgtttccgcaccgccaaagatcaatatgctttcaagtgactcttctctgctgattccttttagcctttcattcatgtctctgtcaaaagggatattgatttgttctgcgatatgcttccaagcgagaaaatgatattcagccgtatctgttatcactccgtctaaatcaaaaatgaccgctttcatatactaatgaccatcacagcttcataaggtttgaggctaatactctttaagtcagcccgctcctgcggatagtttgaaatcagcactttccaacgctcatgaatcagttctggaggcgcttcgaacagagccttttcttccgataaattcacaacgacaagaagcttttccccttgatattctcgaaggtaagaaaagacctgcggatcattctcctgcaacagctgataatcgccatatatcataatcttatattgctttcgtaattgaatgagcttctgatagtaaaagaaaatcgaatcttgatcttccaaggactctttcacattgatatcttgatagcgggaatttaccggtagccacgggtctccggctgtgaatcccgcatgttttccggcatcccactgcatcggtgttctcgcatgatcccttccttttatcatcacggctttgacaaactctttttctgacatcgttttgttttcgacgactagttcacgatatgcattctttatttcaagatcatcatacatctccagccgcatatcgctgttgaccatgccgatttcttctccctggtaaataaacggcgttcctttcatgccgtgcagaaccgttgcaaatgccttcgcacattccttacgcagcttcctgtcattgccccagcgggaaataaccctcggctggtcatggttctcaaaatacagggtattccagccgacattcattaacccggtctgccaccttgtcatcgtcttttttaaagcaatcaaatcaaatggcttgatctgccatttcccatttggcgagttttgttctgtatcaatatccatatgttcaaatgtaaagatcatattcagctcttgcctgcttgcatctgtgtactttttcgcctcttcaatatcagagccgtttgcctctccgactgtcatgcagtcataatgagaaagcacttccctgttcatctcttgaataaactcatgaagacgggggccgttagagtgataacggccgacaatatagctgcggctgttatccgtttcgtagtccggaaaatcggtgtatttagaaatagagccgatcacatccatccgccagccgtcaacgcctctatccatccagaatctcattacatcataaacttcccggcgaacggcttcgttttcccaatttaaatcaggctgtttttttgaaaagtagtgcaaataatactgccctgttccttcatcgtatgtccacgctgagcctgaaaagatcgatccccaattattcggctctgagccgtccggtttaggatctttccaaaaataataatcccggtaaggattgtccttcgacttgcggctttcagcaaaccaagcatgctcatctgacgtgtggttcacgaccaaatccatgacgattttcattccgcgtttatggacttcatcaatcagctgaaacatatcttcatttgtcccaaacttttcgtacatgtttttgtaatcgctgatatcatatccgttgtcatcctgcggggaatcaaataccggggagagccagatgacatccgccccgagatttttgatgtaatccagcttttgaatcacaccttgcaaatccccgaatccatctccattggcatcataaaaactgcgcgggtaaatttgataaacgacagcttctttccaccattcactcattaggcgttctcctttcacatcgtccctgtaggacaactggttcctcataaacgttcatgtgcagcggctcgccttttacaagctcaaaaataacgcgcttttcgtcaaccgtcacattgattaatcgatttcgataattgatgttgaatgaatattcgtcccattctttcggcaaaaacggagcaaatgacagcgtctcattcgcggtgcgcatgcctgcaaagccatgaacgattgccagccagctccccgtcattgaagtaatatgcaagccttcttccgtatcatgattgtaattatcaagatcaagccttgctgtgcgcttatataattcgagcgctttcttttccagcttgagttcggctgcgagaatcgcatggacagagggcgataggcttgattcatgaacagtcatcggctcataaaattcaaaatttcgccgtttttcttccattgtaaaacggtcattaaaaagataaatgccttggagaacatctgcctgcttaataaaattggagcggagaatcttgtcccatgaccatttctgataaagaggccgctccgctggatctaattcgtcaactgcttgcagatctttgtccaagaacgtgtcatgctgaacgaaaatttgcagttcttcactatacggatagtacatgtgctggatgatttctctccagactttcaattcttcttcctgcacatccagaaggcggcgtttctccgctgagatactttcgagactttgtagagtatactccaacgtccaagccgcaatgacattcgtataccaattgttgttaacgttgttttcgtattcattcggccctgtgacgccatgaatcatatacttattttttcgtttcgagaagtgaacacggtcggcccaaaatctgctgactgccacaagaacgtctatcccgtattcttccatatagttacggtcgcctgtataattgatataattgtagatcgcataacagatcgcgccattgcggtgaatttcttcaaaggtgatttcccattcgttgtggcattcatcaccggtgaacgtcaccatcggataaagagcccccttcatccccaattttgcagcgtttcgtttggcagcctccaactgatgaaagcgatacaaaagcaggtttttcgtcacctccggctcggctgtcgccaaatacatcggaacggcgtacgcctcagtatcccaatatgcggcacctccatatttctcgccagtaaatcctttcggccgatattcaaacgggcatcgcccccgtaatatgtcgagaataactgaaagatgttgtagcgtattccttgttgaagctcctcatctcctttaatctcaatgtccgcttttgcccatctttccttccatcgatcagtgtgcctccgttttgcatcttcatagccgttctctaccacatccgacaaaagctccttggctttcgataaaagctcttcctcccgaaaatcacgggaagtcgtgacaatcacaaactttttcaatgatgccttcgtttgataactgtagcgattctcgacatacatttcattcgttttaaagctttcattgacaaaaccctccgtctcgtttgccatcgcggctaaaaccgtgaagtgcggtgttccaaatggattttcgatcgtttttgccgctaaatggccgctgtgagaatcagcacctttcgcttcctcctgccaaaactgttcttggtagttagaatcttcatttgccacatttccatccaggtaaggaacaagcgtaatgacagcatctcccgtcaggcactccgcttcataatgaatcgcacaaagttcttttacagcaaggctaagaaaccgctctgacctgattctgacggatttatcctgaatgcggacaacagcttttcgccgcagaatcccctctttcatattgagttctacctcaaatgattcgattgggttttgatggagatctattttttcaccgtcaacatataggcctatgcctataaagttcatcgcattgatcacttttccgaaatattctggatacccgtttttccaccagcctactcgcgttttgtcggggaaccacacgcctgcaatatatgtgccttggtgactgtcgcctgaatagccttcttcaaaatttcctctgacccccatatagccattggcaagagacgtcaggctttccagcagccgtgtatgctccttattaaatgtatttgttttgattttccattcatcaatctcaaataaccgctgatttatcatcatttcctcccgaatgtaagtttccattatcacggcgggttttggtcaaatatctaaatgcaaaagaaatcatcaaagtaacgccacacgaatggatcatcaatacagtaatcaaatcaaaatgaaccatgccgatagcagctgccgcaaatgccggcagtgctgatgcgcaaatcgctatagatgccgcttccttgaatgatgcaatagaaaccatgtttgatatttttgtgatccagaggcctccggcaagaacaaacgttaacaaaagctggatcatagaaaccaccgtatatgccagcatcatgatcatcggcttatactgtgccaaccataatgtatcgatcaaaacctctacatcatggacgtttggtttctcgagcttaacgtccattttcgcatagccaacagaaaaccccgtttcgttttgatcggtgatcaccagttgatcaggttgaaatatgacggcgttttcaaatccagttactttcaatcgcccattttcaccgcttgtctcatattcatgcttcatatcaactgccatcacattctgcccatcttcaatcctctcagagctcttcccgcctgttagttttccgttcctgatttgaaaaccctgtaattgatcagcaaattgatcattaactccttgaatcgctgacggcataaaagatgcaacgctgaagcgatccattttcacaaacgaaaccgctaacggcgccattaagcaggccgttaaaaacataaagagaaaagagagctgcagccagctgaaggtattcccatagctgcaaacacctgatggagatgcagccgctttcaggcagcggatgataaagcttttattctccagattcttcattgaattacccctttgttccgccggctgtcaaaccggacacaaagttcttttggagaaaaaagaatagaacgcatatcggcagtgcggcaaggatggcgccagccgcaaatagagctactttttgctgctgcggattagaaataaaggattgtaatcctacagcgatggtcagcctttccggtgagcgaagcaaaaactttgccagcaaataatcaccaaacggtgccataaatgcccaaagcgcttgtaccgcgagcattggcttaacaagcggcagaacaattgaagcgaaaatcctcagatgtcccgctccgtcaattcgcgcggcttcatcaatttctctcggcacagtatcaaaataacctttcatcagccacgtgttcatcggaattccgccgccgatatagatcgctgttaaaaaccagtattgatcgagtgcgcctatcagcatcgccaagacataaaaagcagtcagcgccgccattgtcggcaccatttgaatgattaaaaagaatatcaggctcttttttctgcctgcaaaccgatagcggctgtacgagtacccggcaagtgtcacaatcgtaacctgcaaaaccatgaccgatagcgcgatgacaagtgtattgctgtaccaattgagataaagcgtttcgtcaaatagccgcttaaaatgatccaatgtccaagaacccgaaaaatcgagctgaaaagccgccgaattccccacacggaatgctgatgatgccgtaatcagcaacggatatataatgacaatacttaaaagcgtcaaaaagaaatacgtacagattctattaagcattctggcagttctcgcgttcacctacataacctcctcattgccaaaagcattcgattttttgaaagcaatcagtgaaattccaatgacaatgaaagaaattaacagtgtcacagccgccgcaacggaatattggggtgatgtgcctgttgtcagtttataaatccacgaaattaagatatcggtcgatccggcccggctcccgcactgcctggccctccctcattaaataaatagatgatcgagaaattattgaaattaaacgtatactgagtaatcatcacgggtgctgtggcaaataaaatcatcgggaatgtaatatgccgaaaacgctgaataaaagtggccccgtcaatctttgccgcttcatacaattcacctggaatcgcctgaagcactcccgttaccatgacataaatatatggaaagccgagccacgtctgaatcataatgagggctgtctttgtccagaaaggatcagtcttccacgcgatcgcaggcagctcaacaaacggcaggtgattgaatagtggaatcacctgtgcattcaccgctcctatgctgtcgttaaacatgttggaaaaactcatgattgtaataaacgccggaacagcccatggaaataagaaaatcattcgaaatatccgcttgccttttataaaatcctgattgacgaaaagtgccgtcacaatacctaaaatgatttgcagcgttgttgcacagattgtccagataaccgtccagcccagtacattcacaaatgtttcacgataggagccaaggaaaaaaatatttaagaaatttttaaacccgacccagtcaatcagacgattaggcggaatatgataaaaatcatagtttgttaatgcaacaaacagagtcaccaaaaccggaaaaataatcacaaacaccatcatgatatatgccggaagtgtaaatagatatggaaaccctttatcgcccgcatgacagatcatatccttggctgttgtattgacttccaaacccgccgctttcatagcggcggtcttacgcgaatcatggatattaaagatatagaacatgaggaaaatcaccgtcacgatcaattgcagcgtgccttcaatcagcataaacagcgagtgatcttcaccgggaacacttcccaatgtcatcaatccggttagcgcctgtataccgaaaacgcataattcaaaagcaaacaagcctgtgatggcaagaaataagagcccctttgacaattgctgattcgcaatctgcccaagtcctggaatgatcgataaaagccctgcctttcgtttttgctttgcgagtgtgtgatgtttattcattttttccgccctctattcttccggacgctatcccgccgttttatttcacatacttttctttaatattttcctttatgacgtttacagcatcattcgctgatgtttgtgtcgatttttttcctgaagctgcatcaaaaattaaactttccgctcctgtccatacttcagccatttccggaatatttggagtcggcgttgctgtttcatattgtttaatcacagctgacgtcagttcattcttttgctcatcggctttctttcttgcagccgtgttggccggaacttcgtttgtatcctcataaaaagcgtaagcattggcatcatttgcagcatactcaagccatttttcagccagctcgggttcttttgtatattttgaagctacccagcccttcccgcccgcaaaaggggcatattcttctccattgggcaatgtcggaatgggagccgctccgtagttcaatttagcctctttataattggcagctgaccaaggaccgccaatgatcgcagccgctttgccttctaaaaacatctgctgaataaagtcgtctgcgcttgaattgtcttgcattcctttcggccaatatgtctcaaaccatttctccgcatatttcaccgcttctacagcccctttattgttcaggccgatgtccccggaatctgtgccgttttttccaaacacatatccgccgtatccagccaataagccgtacgacatataaaagtcagtccattttgctaaaaatccggttgattttcctttttccgaagcaaacgcgaatcgaggatcttccgttaacttttcaaggtctttaaatgtttttggcgctgtttttaaaagatctttgttgtaatacaaaataagtgtctcaatgactagcggcattccgtacactttgccgtcaactgtcacctgctgcatttctttatcaccaaagctttttgtatgagatggcttaatgtcaagcaaatgtccttgctgtcccaaaccgccgatccggtcatatgcagcaagcataacatcaggcgcattacccgccgggccatcaagaggaagcgcttctaactgttcgaacatttgcttttcaacaatttttactgtgacatcattctctttttcgaactttgtttttatgctttcaatgtattctttatacgtttcttcgacagacacagtcagcacctttttgccatcagagcttgctggattttttgaacttgagcaggcggcaaggccgattgccagaaatgatgccgccaatatggcgaacccctttttaaaaagaaccatctcttttcccccttctatttacgaaactataacaattgtattgtcctatagaaagcggttacaacaactttcgatttgttaccgataacagaatgttatacaggggcggcagcactcaaaatcaaaaattctcccggctgaacggcaatgacgtcgtgatgctgaagcggctgctctgtccatgcatcacagatcctcttattcctttcaatattcaaatctagtaaactgacatgttgaaccacattcccttgattaaagaaataaatcagtattttttcatcaagagtccgcgaaaagctgataaaatcatttttgtcatccagcagattccactcaagatgtccttcagtcaataaagtgttttcctgcttgcgtaaagcaattaaccgtttcataaatcgcagcatgtcttggttttgcttctccttttcccaaaccatacatttccggcataatggatcatttccgccgtccagcccgatttccgtcccgtaatagatgcatggtgagcctgtctgggcaaacataaaggccagcaacgcacgtgctttcttctcatcattgcggcatctggtcaaaaggcgctttgtatcatggctatccagtaaattaaacatcacctcattggcttgcttcatcccattcatcaaatgcgcattgacaaggtaggccatacgtgaggctgggatcgtccggtcagcaaaatattcaatcataggctctgtaaaagggtaattcatcgccgcatgaaattcatcccctctaagccagggttcggcagaatgccagatctcacctaaaatataaacatcaggcttttctgctgatacagcctgcctgaatgtcttccaaaacacgtgatccacttcatttgcgacatccaaacgccagccgtcaatgtcaaattcgcgaatccagtacaaagcaatatcaagcaaatatttctgcacttcgggattagccgtgtttagcttcggcatatcagctgtaaaagcaaacctgtcataattgtcgtctgtgacgggaaaagagtgaatatggaaccagtctttatagcgggatcgagctccgtttttgacgacatcctgccattgcggagacgcgcttcctatatggttaaaaaccgcatctagcataattctcatcccccgctgatgaagctggctgaccaatgtacgaaaaatctctggatccccgaaatgcggatcaatagaaaagtaatccagcgtgtcgtatttatgattagaaggcgcggaaaagatcggcgtcagataaatgccgttcacccctaaatcctctaaataatcaagcttgtcaacaatcccttgcaaatctcctccaaaaaaatcattgacgcccgggtccttgctcccccacggcaatgcattcttcggtgacaagtcttctcttccatttgcaaaacgctccggaaaaatttgataccaaaccgttgacttgacccattcaggcgcttgaaatgtatcagcctcgtgaacaaacggaaatttaaagtaataatgaatcgtttccagtgttttttcgttataagggcatacacccgaacttccgaaaaagatgtcttcatgatcgtctgttacaacaaacgcatattgtaaacgcctaaatggcggcaccacttcagcaaaccaatagtcatgcatttctgtagcagcaattttcctcatcggctgctcgtttgccgaccacttgccatcgttgtactcatagggatcaccccaaatgaatcgaatgtgatctgcatcaccttttttcgtccgaatcttgatatgcacagtccgcccatcataagaataagcatctgtgctgaatggctggtggtgaatcgctgcatattccatcatgtttccccctttgatttccgttttattgaagccggctcatagtttgaaagtatcatgatgaaattgtgggaacaatccttttcaccctgttaccgataacagaataaggcgcttacagcgttgattctcgtacaattaactctggttcaaaaaatagacttccttgtgcagcaccgtcttcattcatttttttcagcaacattttcgcacaggcttcccccatttcaacaacaggctgtctgaccgtagtcaagcgcggcgaggagatgcgatcaagaaacacaccgtcattcccggtaaccgcaacgtcttctggaattcgctttccaagggattgcgccgcacgaatgacgccgagcgcgattcgatcagatgcgcagacaaatgcggcctgattgtccatggatttcagcagttctcttgcaaggcattcacttttcttagaactgttgtcgatccgaaacatattcgattttttaaagcttttattcatcgcccgtatatacccctgttctcttgcacgttcgaaaggctcatctaaatcaatgccaaaaaagacaacttcccgctcccccagccccataacatggcgggttgccataaaagtgcctttctcgttattcacatcgataaagtcatagcccatttcattttgtccaaatacgacgagcggcttctcaaacgcttttattacaccttcaaaatcgttctttctcaagccggtggcaataatgccgtcacattggccaatattaagagaatttcttgttacaagctggagagcatagtgattgcgatccagctccctgctgattcctgtcagcaggttcatgtaatatggttctgtcgtatccatttcctcaagtatcaatagtttcacaacctgtgttctgttttgcacgagcgctctcgccgcataattagggatgtaattcagctctttcatcgcagaatgaacaagctttttcaattcatctgtcaccgtctcagggtgattgatcactcgtgataccgtcatcttcgaaacatttgctttttttgccacatctgacaatgttgccattttcatcccctccttatctgtgcttattatccaaactagtgataaagtcctctattactgttaaatatacgatgcaggcaaaagagaaataaaaaagagatttcccttaaggaaacctcactttgttaaaaacactcgatttttcatgaattcatacgctaggttgctgactccacttcacgagaaagtctcttttttaaatttctgtccactttttttctaaaatcggataagaataagtttgcatttgctcaattaactcatccggccgtgacgagctgtgaatcagttttaggtgcgattcgttagaaaacccttcttgaatgctgtatttcaccattttcatcattggttcaaaatatccgtttacattgtacagtccgattggcttttggtggatgccgatctgtgcccagcacagcacttcaaataattcttcatatgtaccgaagccgcccggcatcgagataaagccgtccgccagctcgctcattttagcctttcgttcatgcatcccgtttacttcaatcagctcagtcagattctgatggacaacctccccgctgaacaaaccgctcggcatgaccccgattgcagttccgccgttttccataatcgcgtcggcaatcgtgcccatcaagcctacgcgggagcccccatagacaaggccgattccctgctcagccatatacacgccaagctctgccgcttttcttttatacgcttcatttcccccagggtttgatcccgcaaatacacaaatggttttcatcttgtcatctccgcatctatatatcgtgttaaacattcaaaaacacactatatattgtcccatcttcatgtgataatatcaatatgaaatacataaagaatgcaggagtgatgaggttggagctggctgatgcagaaaaatggatgaaagagttttacgaaaaaagaggctggacagaatacggaccttttattcgcgtcggctttttaatggaggaagccggagaactggcccgggctgtcagggcgtatgaaatcggcagagaccggccggatgagaaagaatcgtcacgcgctgagcaaaaacaagaattgattgaagaaatgggagatgtcatcggaaatatcgccattcttgctgatatgtatggtgtctctttagaagacgtcatgaaggcccaccaagaaaaactgacaaaacgatttgagcatgcataaaaaagcggccgcgatggccgctttttttaacctgtgatttcatcatggtgatcaaagaaatgctgctttcctattttgtgaaaaaggcctgttttatgcagcagctccttcggctgcgattgcaatcctacaatcatcagctttccattatggcgcttaattcgattcataatgttcccaagcaccgcttcagctgacgtatccatatagtgcaccttattcatgagcagaataagggttttcggttttttctgtacatgctccagcaatgacgattcaagggaatcaattgatccgaaaaacagcggcccttctatggcatacatgctgacagatggatcttctctcttcgccagaacaggatgcgattcctgattgtggatgcgggtcgcttcgctcattcttctgataaagaacacaaatgcgagcagcaatccggttgccacaccgatgattaagtcaaacagaaccgtaagggcgaaggtcgccgccaaaataaaggaatcagcatttttcagtctaagcatgtttgcgacttccttgcgctcactcatattccatgcgaccaccatgagaatcggtgccatactggcgagcggcacatgggacgcataaggcgcaaatacaagcaggacaaggagaacgactacgccgtgaacgacgccggaaactggagaaaccgctccgttttttatattggtcgccgttctcgcaatcgctcctgtagccgggattccgccaaacaggggcgctgccatattcgcaatcccctggccgacaagctccttgttgctgtcatgctttgagcccttcatgttatcagcgaccattgcggacaaaatcgactcaagtcctccaagaagcgcgatgacaagcgcagctggaaacagcataaccattttatccaaagtaagctcaggaaactgaaattccggcaaatggcgggggatttctccataagttgacccgatcgttgccatgcggtcagggaaaaagacaaccgcgaccactgtggaaataagaagcgccaacaaagcgcccggcactttaggcatcaccttggcggatacaagcaaaatgacgagcccgatcacagctgtcaaaatggcatacacgttaaaggtgccgagctgctgcacaatttcaaacatgttgtgatgaaagttctcatgtttttcaacatttctcaatccgagaaaattagcgatttgttccgtaaagatcagcacggcaattccggctgtaaaaccgacgataacgggtttgggcacgaatttcattatttttccgagcttaaacagcccaaacagtaccagcatcactcctgccataaaccccgcaatcagcagattttccaagccgtactgcatgataatgccgaataaaatcgggacaaaggcgcccgtcggaccgccaatctgatattttgatcctccgaacaaagaaatacaaatccctgctataacaacagtgtatagcccatattcaggctcgactcccgaggcaatggcaaacgccattcctaaaggaattgccacgacacctactacgatacctgcaatcaagtctttctgaaatttctgcaaattgtatcccttaaatctccctgagaatcgcatattttgttataacctcccttatgagtgattgtttataagctcagtttcataaccgttaatgaccacatcaagttttcctgtttcaggatgaatgacaagtccgtgaaccggcacttttttcggaagcagcggatggttcttaatcatgttcacactgtgggaaacgctttcttccacgctgtgaaaaccagtcagccacgttttcaaatcgagtccggcactcgtcagcaaattcaggcagctatcctccaccccgcgttcctttgctttctcaagaatcgaggacgcattcagcccagacattccgcattcatgatggccgacaatgcatacctcttcagcctgcaattcataaatcgcgaccagtatgcttcgcatcacgcttccaaatgggtgagaaacgatggctcccgcgttttttacaattttagcatcaccgtttttaagccccattgcttgcggaagaagttctgtaagccttgtatccatacaggtgacaatgacgagctttttcgaaggaaactttgtcgttttgtacggttcatacttcttctcactgacaaaccgctgattgtgttccaaaattgatgttaaagaaaccatttgattcatctcccatccatatgattttgcaagccttcttacccagcttacagtaaggaattatagcataggaataagccaagaaaaggctttcaaaaaaagacactataattggactgtagaatcaaaacataaacatttatatctttcaaagataataaaatttatatttaatgcatcctataatccggctgcagttcgcatatcgatgatttgtctgacaaaaaatatgggtgaattctgataattaaaaaacttttttaagcagatttagctgttcgatcttcattttaagttcaaaagaaccagaaattttaaaaacgcagctatatttttaacatctatttatttccgatataatgaattagacaacagccataaagggggagccttgttgaaaccatttgtatttatcacaaaaccgattcctgaagagattgaagcattcatcggtgaacattgccgttatgaagtatggcaggaggatacgcttccgagtgacgtgctatttgaaaaattaaaagaagcggaggggcttttaacatcagggacgtccggaccgtcaatcaatcgtgagttgctggaacacgcgcctaagctcaaagtggtcagcaaccaatcagtaggctacgataacttcgatatagaagcaatgaaagaaagaggagtcgtcgggactcatacaccttatacactggatgacacagttgcagagctggctttttcactgattctatcttccgccagacgtgttgccgaactggaccgttttgtcagagcaggaaaatgggggaccgtggaagaggaagcgcttttcggaattgatgttcatcatcaaacgttaggcattatcggcatgggcagaattggagaacaagcagcgagacgcgccaaatttggttttgatatggaagtgctttatcataaccgacatcgcaaacaagaaacagaagacagcatcggcgttaagtatgcagagcttgatacattgctggagcaatctgattttattcttctcattacgccgctgactgacgaaacctatcacatgataggagaacgcgaatttaaattgatgaaggattcagcaattttcgtcaatatttcccgggaaagacagttgatgagaaagcactgattcgcgctcttcaggaaggctggatcaggggagccggcttagatgtatacgaaaaagagcctgtcacccaagataatccgctcctgcagctggataatgtcacgctgcttcctcatatcggttcagcaacagctaaagtgcgcttcaacatgtgcaaacaggctgccgaaaatatgctcgcagcgatccaagggcaaacaccgaaaaatctcacaagagaatttcaataaatcaaaaatccggtctgataacagaccggatttcatattacatacgctgaagaacagcacgcttataaatatgacgggtaacgatataataaagagcttggaatacaaaataaatgaagatgacaattacggcctcaagaaataaattggaattcagcatattacttaacgctgcatacgcaaagcccgcgtgaatcgtacctgcgataaatgggatgaagaataaaaatcctatttgctttccaaggatcgagtgaatctctttgtccgtaacccctatcctttttaaggctaacacctgcactctcgtatcttctatttccgtaaacatccgcaaatacagcatgcttccttgcacgataaaaaacagcacgctgacaaacagaccaataaacagcattaatgcaactccctgctttacaatttgataactgggagcacgtgtttgaaaatcagatgtatgttctttcggcaccatgttttcaagcttttcagagacatccaccgtctcctgccaatgctcaagctcataacctaccattctcatctgttccttcagcggcacatcctgtgacagactgtcaaagctcttttcgctgacaaccaataaacggctgactccatcgacagacatcaatatccctttgttttgctgctttttcatgacgtaggaaagggtttttcctgacttcatatgaaatgctgctgtttccccttctccaaatgtgtctttcaccatcatttgaaaagaaacattaataaatgcttcattttcttgtaaatgaataactgggaaccctttttcctttgcgacttgattatagactttttctgaaatcagcaaagcttccgcttccatcttcttatttccatacggcaagtctgactgaaaagtgacaggaatccctgtggcatccaccttatacttgataacagcatgagcttttttcaatgtattctcagctgtctcaggcttcatgacctgaaagcgggaagcatccttttccacccaggaaacagactgaggaatgctttgctcctcctgcctttgtaaatcggaataaaacatatagatgacacctgtagctgttaatatgaccgctgtaatgacagaggttaaaaacagcatgcgtgcatgatccttcagcctgaatatcatgttggaacgcacaatgatattcgtgcctttgtagaagctgtgtttctttcggtacagcatgcggaaaaacgccacactgctttgggtaaaaaagaaatacgtgccaattaacactaaaatcaaaattggaaaaacccgaaacatcatgtcaattgcattggctgttgcagatagataataaccgctgccaagacatagcaaagacaatacagtgagccatttcgaataaactggcaaacttttcggctttttggccgatttaatcagttcaatgatttccagcttccgaatccgtcccagtgataaaatgagcagcgtctgaaacaggatgagaaagccggcaattgtcatcacaaacgctttcggcacaatggcaaacgaaatcggcaccttcacgctgagcatccatgtcatgatcataaaaaacagttttgaaaataacaggcctgctccaatgccggccgcaatcgccgcaagagaaataagtgactgctcataataaatcatcttgcgaagctgctgctttgatgtgccaaacagtgtcagcagcccaaactctttctttcttgcctgcaaaaacgctgaattggaatatgtaatgaaaaatatacaaaacacaatgatgacgacaagagctgcgctcaagcatgttttgacaaggcttccgccatatatattgtcttcattgacatcaggatgaaaaataaatgatgtgaagacaaaaaacaccgaaacggcaaacacacagcttaaaaagtaggccacataccgttgcagattcccaagaatgtttttacgggcgatagttctcaaattcatgaaaatcgcctcccaacacactcaaggtatccaatatactttgataaaacacctgcctgtttgttcctctgtgaatctctgaaaagaaacgtccgtctttaataaaaacaattcgtttacagaaacttgctgctgtggcatcatgcgtaaccaacagaatcgtcgcttccttttcctcattcagctgagccagtgtgttcatcacttgctttgccgattttgagtcgaggtttcctgtcggttcatcggcaagaatgagcgccggattgtgaataatcgctctggcacaggctgcccgctgctgctgtccgcccgacacctcatatgtgcgatgatcgagaatgtgcttgatttgcagcgtatccgccagttcatccaatcgggcttccatttctctcagctttaccttatccaatgcgagcggcaagagaatattttcacgaatcgtcagcgtatcaagcagattaaaatcctgaaagacgaagccgagttctcttctgcgaaacaaagccagctcttggtcctttaacgttttcggctgaatgccgttgatcatcatctcgccctgggtcggcttatcaatggtagccagcaaattcaaaagcgtggtttttccgcttcccgacggccccataatcccgacaaattccccttttgacacactgagatcaaaggcgctgagcgcttggtatgatattgttcctttatttgaatagtacgttttcgataggttcgttgtttgcaacacgttcatgttctgctcctcctttttctttattataaaaaggaagtcagcatcctcccatcgaactttcttgcaattccgctccccaaccttacaatgctgtcacattcacgagggtgtcacttgaaaacacgatggtcatcacagtgccagccccttcttttgattccgcatacagcttatggccgagacggctgcacacctgttttgctaaataaaggcccattccagttgcctctttcatggttcgtccgttttctccggtaaaaaacgcgtcaaaaatccgcggcagatcctgcggcggtatgccgattccttcgtcggcaaccgacaagcgcgtctcatgtccctgtgtttcaatccggattgtaatagggtctcccacaccttgctttgaatattttaaggcgttgaaaaggatttgctcaacaacaaaggaaagccacttttgatcactggaaatctgaacggcatttggcggcacatgtaatgttggaaaaaggcgccgtttaataaactgacgtttttcctgattgatcagtgaacgaaccatttctgccaaatcaaaggtttgcggctttacatcaaatgcaaattcctccagccgggccgtttgcagcatcatatcaagaccgtggcgaaatctctcattctcatcctccagctcctctaaaaacgtcggaaaagaggatgaagttccgttttttccttcctgaatcattaaggatatgacggataccggtgttttcatatggtggacccattggttggtgaaggtataatgctgtttttgctgattgatatattgtgagagcctgctttcgtattgctgcccgagtgcgttgatcatcttcgtccaaagcgcttgctctcctgttcttggctttctggctttcaaagactgtccgatgtcattcgaagaagaggcttgttctgcaagctttttaacatatgtgagaaaggaaaattgccgaacataatcaacagcaaaacctgcggctaaaagagtaccgggcaaaatccatatgtacatcatattttctttggaaggttctgcgccgctctctacaatgcttaaatgcgcaatcagcatggcggatcctatccctaataatgaaaatagaataatggctaagcggtcgatgagataagtctttaacactccgcttcatccttccgattgacttgaaattgatagccttgtcctctgattgtggaaatgcaatctttcagtccggcattctccagttttctccgcagccggttgacattgaccgttaacgtattgtcatcgacaaaatcaacgtcatcccataacgcctccaatagttcatcacgagaaacaatttttttatgctccctcacaaaaatagagagaagctgaaattctttttgggaaaacagaatacgggagctgttccattcggcctcattttgatcaggataaatcgtcagcccaccaagctccactattctagattcctgcggcaaagagggcgaatattcaccatatgtgcggcgcaggacgcttttgattttggccatcactacctctagatgaaacggctttgtgatataatcatcgccgccattttcaatcgccattacctgattcagctcatcggtccgtgccgatataaagataatcggcgcattggaaatggtacggatttgcctgcaccaataaaacccgtcaaaaaaaggcaggttgatatcaagcagcacaagatcaggcttcatttctgcaaattccaattttatatcattcagctgttcagcaattttcacttcatatccgtatttttgaagatgaccgcccagcaaagaagcaatccgctcatcatcttccacaagcaaaatccgatacacgttgatcccccttatatgtacatcacgatgatttttctagaagattccaaaattattatagcatgtgcagaatagtaaatcggactttttctttttgttataatagaatgataaaggtaaaattttcataataggcaggtgtcgtgatgaagaaaatcatgctgtttctggcaatgacgtcaattctttcagcatgtcagcccaactataccgggaaatacatagaaattggggatacactaactgaatatgaaaaagagtgttttaaagagaatgaaattccttataaatacgaaaagggaaaactgtatatcccagaagatgcatttgatacagcaatctacacttgttcataagaaaaagcttgcagatcctgcaagcttttcacgttacaaaaaatgagtatttaatttctcttcaaattctgaagggccaatgtcacttttttgaatgtcactgccgttttcatgaatcgtaaaatggcgctctgacatgaccatccttccgctcggcgtcagctttgaggcaagcggggatttgttaaaaggagatttttcatgagagtgaatgatgtccttcatgttatctaaatcaccgagatcactctcttcaagagtaaaggcgtacccgatttgccagccttctcccttgtccatcagcagaacatggctgcccttttctgtctcttctcttttgattcggaatgacccgactggtgactgtaccgtttctccggaaagcggtatcggctggagcgccaggttgatgccgaagccgatatcaacgaggtaatcgccgttttccgcagacagccatacagcagcatgcgtcccttctagtgcccatccctcttgattgcctgcataaaccgttcctcgaatgagcttcacatgaaacccggcctcacgcaagacaaaataaaggaaaccatttagatcgtagcataggccgccgtgctgatctttgagcagacgtcgccatagctcttcttttgtgatcttataattctcttttgcaagtacggcacggttttcgaatggaaaacggtatgccattgctttaagaaaaaggggaagatcgccaaagctgacatgatctttctcccagccgattttctgaaagcagtcttttagaaagtcactcatttttatcacctaaacttcttcttgaacgtaagcagccagcttctccagcgcctcttgttcatcttctccctgggcaatcaaggtaacctcagtgcctgtgcttaccgcaaggctcatcagccccatgatgcttttggcgtttacttttttcccatccttctcaagaaacacatctgacgtaaaccggtttgcttcttgtacaaacaaagcagcaggacgtgcttgcagtcctgtctttaatcgaacttccactttctgttgaaccataagatctccccttttctttacggttattttaaagtgacggtttgccctgtccgcagctgttctgcgatttcgtcaagttttctcagcctgtgattgatccctgatttgctgattttcccgcttgctaccatttccccagctctttcagcgtcacttcctgataatcaatccgaagctgcgcaatttcccgaagtttttcaggcagcgcctccaggccgattctttcatcgatgtatttaatattttccacctgtctcagcgatgcgccgatcgttttgtttaagttggctgtttcacaattgacgaggcggttgaccgaatttctcatgtcccgaacgattctgacatcctcaaatcgcagaagcgaattgtgagcgccgattacgttcagaaactctgtaatcttttcagcctcttttaaataggtaatgtagccttttttccgttcaagcgttttgctgtttaactgaaactcatttaacaggtcacataatgaatcgttatgctccttataaagagagaagatttctaaatgatacgaggaggtttccggattattgaccgaacctcctgccaaaaatgctcctctcatataagaacgcttgcagcatctctttttgaccagctctttcgaaatacttcgttcaaacacaaaattctccccgagtatttttaaatcctctaagatcgcttttgcattttctgaaaaacgcacaatatagacgttattctttttcagccgcattttctttctgaccagcagctcgaccgacacatcatattgttttttcagcaatgtatagatgcggcgggcaatcgccgcgttttcggtttgaacatcgagtacgagatggcggtttgtaaatgataaagctccattcatccgaatgagtgcagacagctcggcattaatgcagcagtccttcacttccagattcgttaattctttttttgtttctgatgcaaatgacatatagccacctcatttcaaggcttcattctttcagtaaatcaacaagaagagaggccactttatgtgtatcgtgacgtattacgtcatttttatacgttacaatttgatctctgatgacttcaagccccatcgctttcagctcttcaatatcaaaatcaacaggacgcgccgattccatttcgtacttacgctttatttcgtcgggaatgtcttcactgttcactaatatcgtatcaataaaaccgcagcccatatgctgattgagcgctttcacatgatcagcagcggtgtaatggagcgtttcgccgggctgagtcatcacgttgcaaatgtatacttttttcgccggcgcctttatcacttcttccccgatttttgggacgagcaaattgggaagaatgcttgtatagaggcttcccgggccgataataatcaaatccgcttccctgatcacgtctattgtttccggcagcggatcaatctgttcaggcgtgagaaaaacacgcttaatacgctgtccgtattccgggatcgttgactcgcctgagaccacgcggccgtcttccatctcagcatgcaaaacgacactggcattggcagccggcaaaacctttcctcttacattcagcaccttgctcatttctgtgacagcgtgaaaaaaatcaccggttatatttgtcatcgctgccaaaatcaaattcccgagagaatgacctgttaagtcattccctttattgaagcggtgctgaaaaagatcttcaacaagcggctccacatcggataaagcggcaagcacatttctgatgtctccgggaggcggaattttcagttcattccgcagacggccagagcttcccccatcatcggcaactgttacaatggccgtgatgtcaacgggtttatgctttaggccccgaagcaatacagaaagaccagtaccgccgccaaagattgcgattttcggcttttgtcccatcttatttccggcttctcttttcaatgtcccggtgagtaacatgagtatagtaatcctttttgaaataatcagctaaattctcggctaatgtcacagagcggtgctggccccctgtgcagccgatcgcaatgacaacctggctttttccttctcttttataagatggaagcataaagctcagcagatcaattaatttctcattgaacttttgcgtttcattccacttcatgacgtaagaggaaacctctttatccttgccagtcagcggccgcatgctttcgatatagtacggattcggcaaaaatctgacatcaaagacgagatctgcatcaattggaataccgtatttaaaaccaaatgacatgacatttacggtaaatgtctctccttggtttgtcgcaaagtgcttcacgattttttcacgcaaatcacgcggcttcatgtcagacgtatcgtaaatgatttgagagcggccttttaattcctcaagcagctctcgttccagcgcgatgccttcaagcggcaggccagtcgctgccagcggatgcgagcgtctcgtctctttatatcttgtgacgagaatggaatccttcgcgtccaggaataaaattcgcggtgtgatccacggattttcggccatttcatccagcgcttcaatcagccggtcaaaaaattcgcggccgcgcaaatccatcacgagcgcaactttgctcattttcgaatttgattccttcatcagctctaaaaacttcggaagcaatgaaggcggaagattatcgacgcagaaatagccgagatcttcaaagctttggatcgcgaccgttttccccgctcccgacattccggttataatgacaagctgaatatcatgtgattcactaacactcatctttctcccccctgacttgtctttctatttgatgtgctgcgggtctaaacgataactgagcagctcaaattccggtgtatacgtaaatgtgccgtgcagcagcccttgtcccttcatcataaaatcaaggatatggccgtctccaggggccataggcaggttctgaatgtcattgacatcatgccactgcagtttgccttcctctgattctgatacattttgtcctgtataagaatccgcgacaaacgtaaacatcatccactcggagacaatgtggtcaccgtctttaataataaaggtaaaaacgccttttaattgaggatttatgatatagataccagtctcttctctgtactctctgatgacggagtctctgactgattctccgctctccatcttgcctcccggcgcgacccaccatccgcgtctcggcttttgaagcagaagaactttgtcatccgtctgaagcacacaatttgtcactctttgcaagtacgtcacctaaccttcgtcctgtcatcgtctctttattataccgcttcaagatgcctcccacaatgaagagacattgacaatcttttcttctattttacagcatattcattccttaattcagatgattttgctgtaactggcattcatcttttatttatggacaaaaaaaggacacggataactggagaatccgtgccaaaaaagtgtattcattataaaaagggggtcaattactttattaatcataaccgaaaagcattacacatgtgttacagcggaattaaaacccagtaacgtaatgtgaaactcgtatgacagccctttttattttaaggttttcagcgtttcttgaagctcttcaacataatgctgtacgctttgcgccgcaatacttccgtctcctgtagccgttacgatttggcgcagtgatttttcgcgaatgtctccggcagcgaaaattccttcaacctttgtctccatgcggtcatttgtttcgatgtagccttcttcattcgtaatgcccagattctcaaacggtttagacagaggaagcatgccgatgtaaatgaatacgccgtctgttttgaattcactttcttcaccggttaccgtatcgacaagcgttacgttaccgactttgccgttttcctcatgaatttccttcacggttttgttccataggaagtcaactttttcattatcaaatgctctcgcttgaagaatactttgagcacggagtttatcacgtctgtgaacaatcgttacttttgaagcgaaacgagtcagatatacgccttcttcaaccgcggaatctccgccgccaacaacgactagttctttgcctttaaagaaagcgccgtcacatactgcacaataagatacaccgcgtccgcccaattctttttcgccaggcacgccgatttttttatactccgcacctgcagcaatgatgacggcacgcgctttatattcctttgagccggctttgactactttatactctttgccgtcaacgacttctttaatatcgccataagcgtattcagcgccgaactttttcgcatgttcaaacattttgttagaaagctcaggcccaaggatactttcgaatccaggatagttttctacatcttccgtattggccatttgtccgccaggaattcctctttcaatcattaatgtcgataaattcgctcttgatgtgtatacagcggccgtcatcccagcagggcccgcgccgattataatcacgtcataaattttttcttctgacacactattcactccttaaaccatcttttcaagtttgggctctttcttataagataagaatccccatcaaacgtattccttacccatatcctataaaatctcatggtgatacgctatttttttgctcatttttttcgaaacgcgattaaatgtatttcaaaagggtatgtatattaataaagaaagagccttctgtccatagaaggcccttgtcttatttattattgaacaacacgtcttacaacgcctttaaatgctgctttccagtaaggattgctcatagagtcaacagatacaccatgagatgtattgtcgtttaggaaagtaccgtttcctaagtaaattccaacgtgaccgtttgttttatatgtgtcaaagaaaactaagtctccgcgtttcatatccgatgcgctgacagcttgtcctctgccaactaacgtatcagttgttgttccaccgacaggtccaaggttaacacctgcagaagcgtatgcccagcgtacgaatgatgagcagtcaaaaatacggttgttgatatcagactgactgcgtccgccgccaaacttgtacggagattgtcctacaatgcttgaaccaacgctgatcgcgccttcaattccgccagagttgctgataacagtgccgcctgaattgctgtttgagccgctgctcttcttagaagatgagccgttagacgaactgtttgatgaaccgttagaagaattgtctgaagaatcatcagatgagcttgcttttgctgattcagttgtagccgtttggctgtcatctgtttgtgtttcatcagatgctttttgtgcttcttcctgctttttgatcaaagcagccgctgcttcttgttcttttttgatgcgtgcttgttcagcttcagtatttgctttttgatttgcaagttcagacgcctctgattttaattcagaaatcgctttagccgttttcttctggcttgcttttgcttcgtcgaaaagcttgtctttttcattaagctgtttatcaaggtctttttgcattgtttctaatttagccaatgcagcttgaacttctttcagcttgtcattcaaatccgcttcagaatcctcgagcttcgctttatcctgctcttgctgtttgattaaatctttgtctgcgtccacaatagatgaaaccgcagtcgcacgagagataaagtcaccaaagcttgttgatcctagaagaacatctatgtatccttgagatccgccgctttcctgtaaagaacgaacgcgttttttcaggatttcattgcgtttttcgatacgtgcttctgtttctttaatctcttttttcagttttttgatttcttcttttgttttatcgttttcttcttttttatcttcgatcttgttacttgtatcaagcgccttagcgttaatgtctttcagttctttttcaatctttgattgattttcctgaagctcacttaattctttttccttcgcttcaatgctggaagcaacctcagattgcttgctttcgattttttgtttcttttcatctaatgtttccgccgatgcagttttacttgtaaatgggatcaaaaaactgcttgtcccgatgacggaagccaaaccaagtgtaattaaactctttctcactttttatatcctcccttttactgtgaacctgtcctcatttggaatcgtattttgaacatcaagtttcgttcctcatactctacgaggaatgatggttgtttatggttaattattctgtgcatctcttattctggttgtatagcgtttatttcacatcatatgtaaaaaacactaattccttatgtacgagaatcattataccatcaagtttcgacaaattagcgataaattttattacatttatgtttcaaacagatgtcaagtcacacatcatttgtcatttttcttaagcgtgtaaaaaaactgtcgatattattttcttaatataatctatcaaacaaaaaaagagtcgattaaataaatcgactctttaaaatttactattctagaatatcatcaatatatttcatatatttcgtcaacgttgccggagagatgccgaatcgggccgctgtgtcttttttcgtgtcttgcttgccatgggcttctttccaaatataacagatggctgctgcccagcctttctcattcttcaacggagcagctgcacgaatttgctggatgacatggaaaacccagcagctcatgacttctgttttcatctcttctttttcagcttgctctaataatttgaccgtttgataggcgaaaagtgcatcctctgaaacgtcagcagccgcagaatctccatttagaagcagctttacaaaatgattttcaaaaggagcggtaattctctttgagcgtatcaccgcttcaagatgctctgtttctccctttgtgctgctgatataataggctgcgagacgctgctccacagatgaaggaagagcttccctccgctcaatccaaggcgccgggcggtcttcgccgggatattgcgactcgacttttctccagatcgtctcggcaaagtcggtatgtcccgtaaaataagcagagcaggaaagccagtaaaagaaggtgtcgtcaccttcaaagccggttttatataatgatttgagccatttatatccgatctcgtagcggccgacaagcgccaaagtagcacccaatttataacgctgctccattagcatcggatagacattggagagctgatcactcaattccaccactttttcgtcttctctttcataatagtagaaaacgagaagattgcataaggcgtgaagatttccttcattatgagaaagcacttcataagcggtttgcttcgcttttacaacgtttccagaatagaaataggcaagcgcgagattgttgtatgctgaccaaagctccggatattcagctgtgatttcctcaagcgccgcaaccgcttcagcaagctggccgctttccagcaatgactttgcccgatcctgtttcaccagcagttcatcgtgatcatacaacgaatcttcaatgccgtcgtctcctaaatcgagcaaatcaagcagactatcgttttcttcggcgaattcaccatccgggtccgcatcagaataagcggccgcttctttataagcttcctggaagagccccagatgggcaaagttattcgctttaaagtaatggcactccggcatttcggcctccagatttgccatgatatagtcaagaagatcgttcgactcttgatactggcccatttccgaataaatgaccgcaagctgtgaaagcatctctgaatcctccggctccaaatgaaccgcgcgctgaatcagtttgcttgcccgttttagattgcgctctttatacgctttcaagcctttatgaaaaaaatattgtccatcttgaagcagctggacaatttgtgcgtgatttttatgttcagaagtgtgttttcccacaactaccctccgttttatacaatattaccgtcagtagtataccataaatcgtaagcccctcaatagttcaaaaggaaggattgggaaaatccctcctcttttttattggctgattcgaccaaaatttacccggctttgttttctaagtccgcattcattttcagctgctgttcagcaaaatccctataaagaccatgggaagccattaactcatggtgtgttccacgaccggtaatttcccctttttcaacaaacaatagctggtccgcatctacaacggtagataggcggtgagcgataacaatcgttgttcggccctccatcagcacctcaagcgcctgctgaactgatttttcagattggctgtcgagacttgaggtcgcttcatcgagcataagaatgcttgggttacggagaagcgctctcgcaattgcgattctctgcctttgtccgcctgacagcataatgccgcgttcgcctacttctgtatcaaactgattcggcagctcctttataaaattgagcgcatatgccatctccgcggctttttcgatctcagcatccgtcacatctcgttctaacccgtagcaaatattttctctgattgtcccggacattaacgggctttcctgtgatacatacccgatatgctccctccacgattcaagcgagtaagtatcgaccggctcgtcccccagtcgaatggtccctgcagtcggagtataaaaacgttcaagcagcttaaacagcgtcgttttccccccgccgctcggaccgacaatcgctgtgactttacctgcttcaatgacggcgctgatttcttttaaaatcagctgatcaggcttgtatccaaaagacacgcgatcaagctgaatagggagatgcgcattttcaatttgttttcctgtcactgtatcttcttcttcctctgctaaaatctcaatcattcgttctgttgcaccgattgatttttgcagctgtgtgaaaaacgttgtaatctggcccatcggcattataatttgaaacaaatataaaataaaagccacgagcgctcccgccgtgagttcgcctgaagatacctgcatgccgccatatccgatcactgcgacaagcgctgccattagcacgagtgagataagcgggccgacaagcgattgaaccttggcttcacgaacgccaagcttaaataatgaggaaatccccatcttcccgcgcccatattcgacatcctccgcatttgaagctttgacaagtctgatttccgggagaatttgattcagcaggcctgtaaaacgggctgtttcatcttgcgtttcccgtgagatagaaaacatcttccggccaatcggcatcaagatgagagcggccagcggaacgaccactaacacaagcagtgtcagcttccagttcataataaacaagattgtcaatgatccaatgacagaaatgatgcctgtaataaatccgctgatatgggttgtaatcaattctttgaccaccatcgtatcgttcgttacacggctgactgtttctccggaagcatttgtatcgaaataagagacaggaagcttaattaatttcttccatagtaactcccgcagcccggaaatgattttttgtccattatagttaagcgcataggtggcataagcgcttaaacccgcctgaacgaaaaacaccagcgcgatcaaaccgatttgcgtgcctgacagatttgacatagaaaaaccatcgacaagctgcttcgttaataatggaatgagcaggctgaccagcgtggttacaacactgagggcaagcgcaaaggcaagctttccataagaaggattggtccgtcttactaaggcaaaaaagggtttcaatttacttttagatttttgtttcttggttggcatatattttcctcctgtttcagcgttcagaaaggtgaaaagtcatagcaaaaggatgatttttactctttctcaatcatatcaatggagaaagactttttcagtatatttttaccgtgatcaaaataaaaatctcccactcattgtttgaataggagatttttatgttagacatctttcacaggcttcttttttctataagtcaatgttacatcctgctgtcgcaggtcttcaattatcattttgtatcgatcaacttttgcggtatgttcttcttttatcatctcaagggcagcttttcgtttttcgcttttagactcaagctctttttttatttttttacaatcaaccctttttgccctttgatttcctcttttaatgaagactcaaatttctttgtcaggctgagaaagtcgttgatcggttgattgagggtgcccgctttccccttcatttcatcttgggtaagaaacatataggtcgttgatacaatttctatttcactttctgaaaataaggaagtcactcttcatattcctcctaaggctgaaaatcaaataactgagaaatcatttcttctttttcaaacagcttttcaatactctcgcggatatttttgataaaatctcttttttctgttgtctgtttttttaattcagcaacaattccatcattagcaggtagcgcacctgtgtgaaatgattcatgaactgagattttctccaatttatcgaatgtgtggctgaaaccagctgcaagccggaattgaagatcgaaggcataatgcgaagggttttcttccatatgatgaatagccgtgatgatcgcctgctttttgtctatgaaatcttcatcgatttcctgactgtaaaccttctggtacttagaaatcgcatcttccaaatcttcaacgattttcataccgttttgatagattctgacagcggatgagagattgacttgaatcgtttctcccgagccgctcttccctgtaaaataaatatcggaacctttatagctgaagcctttttcctttgacaaggcgttgagcatttgaacgatactgtggccgtcgacgataagttttagtgcgtcttttgtttctgtgtcgagtgttttcaatgaggacagaattgattttacgtagtccactatttcaccaacgtcttttaaagcttgcataaattggccatgctttagatggtctatgaaatgttcgtaccgtaattctatgcctcgcatactcgcattaatattcgttaattcttttttgatcactttcttttgcgtttcatcaatataaccattttcagctaactgatctacgaccggtccgctgtttctcaacaaggtatgaagaaaacctaaaaacgacggcagttcctcttttattcggccatacatttgcttaacatcatcaaaatgctcatataggacacttactttctttaaagcgccgtctgtgtttttcactctttcaatcaggtctatgtctatcccgctggctgcctttataaaaccgttcaagccgtctttttcatagtcatccttatatttttgaaggaatttttgaattgacctcacatcttcgtcaggaaccccatccataatgtttcggatgccttttacacttgtatttgtatctgccatcttcacatcaccgaatgtaatgaaatcggccttgccgctgactccatacagcgggtcatcttttgagatgcgttggatgatgttcgctgtgacgcctttgtcttcataatatttttggatttcttttttaacttttctggcgggatatcattaatatcttttaagcgtctaatatgaaatttatgcattaacctatctctcaaattcaaatcagttgctagtaggtggtcaacgcttatttgagctccgttaaccccataaacttcatcaaattctccatcaattaattgaaccatcacctgattattatttgccagtgagtgccccatagcaaaggtctttaaatcattagaattctctgtttctcttttggcatttcttacaaactcttttgtcgcttggtactggctgtcatctatccctaaaaagagaccaaagaaattgtatgaccagtcttcgttatcagcactcccctctgaaataatatgaagttgattaacgtgttgtttatcatccttaatataaatagctgtaccatcatatccggactctcttattgatgtatctattttcgaattttttttaataagttcattagatgtgtatatttccacactttttggaaggtctcgatgtgtttcttctttgtatattctacgcacctcgacttcaaaatctgttttagctctctttatttcactttcagtatcagaagcaaatctttctttataatcgtactccaagtcaattaaacgcagctttacattttcattttcaaatatattcttattttccattttctctatttctcctttttaacttttaaaaaggtaatagaatcaattattttccgaacttttttttctgcttcttcttcctttaatgaacaaacctctttacccttatagcaagaaaaacgaaaagaatactctattcctaaataatcctcttttttagatttaacataaccaaaaaatctataagaaaaattattcttttcatctacatcatcaaaaatacttttcttttgagcagaatatacaattttatcagatagctctctttcttcgaattttcctttatagctatttctaccgcttacaatgtcaagcattgtgtccttgtcattcgcaaaacttttttcttgatgataatctaattgcccgtcatattgaatgttagtttttttattgaaactatcaaatactattgtttcctcattttctcctttacttgaaagatcaggtacgtactccccatcctccggaaacaacatcctaaaccctttcagcttagattccagcaaataatatcctggttcctcttcttttgttgacaccatatactctctcgttttctcgtcctgaaacgcaggtacttgaggcagatccttgggatccatgtcttttggttttaccgcttccgttttattgtcatttgtgctgtttttatcattgtcattcatactgcatcctcctgtcagggcaagtaataagctgaagcaaataaagatgatctttttcattacgaacctccacgggttttgtgagaatagtattctatttttatatcaaaaataattctattgacctggttaagagatgattatttcatcctttttcatgttacatcatggcggaatttggataaataggaaatgagactcggttttgatctccttttattaactaatcatatataacacctaatataaatctaaatacctattacttttttcacaaaacaaaaagagccgtaacatacggctctttactcttctttctcagaatggcgttttttcaatacgtcaagcacatcatccagcggcaaggcttgttctctgagcaggacaagcaggtgatacagcaggtctgccgcttcccatttgagttcctcgtggtcccgatttttcgcggcgatgatgacttcggatgcttcttctccgacttttttcaaaatcttatcgacgccttcacggaaaaggtaagtggtgtaagctccttcaggcatctccgcttggcgttccgcgatcacgcgctccagttcgttcatgatgccgaatcggcctgcggcctgttcttctgtttgttccttcgtaaaacagctgtagctgccagtgtggcatgccgggccggacggctctacaagtacgatcagtgcgtcctggtcgcagtcataccggatacctttgacggcttgcgtgttccctgaggtttctcctttatgccataacgcttggcgtgagcggctgtaaaaccatgtttccttcgtttccagcgttttttcgtacgattccttgttcatatacgcaagggtcagcacttctttgcttgccgcatcctgcacgatggcaggaattaatccgtcctcgttaaaacgcagctcatctgcctgtttcatctcacattcaccccgtactctttcaagtatgatttcacttctttaatcgatgtttctttataatgaaaaattgaggcggccagcgcggcgtcggcttctccttttgtaaaagcctcaagcatatgctgtgcgtttcccgcgcctcccgaggcgataacagggacggggacagcttcggaaacaagctttgtcagcgtgtggtcgaagccttttttctcaccgtcagagtccatgcttgtcagcaatatttctcctgccccacgtttgacgccttcttttgcccacgcggtgacctcccaatctgttttctttctgccgccgtgcgtgtagaccttatatgtgtcagattctttgtcgtacttggcatcaatggcaagtacgatgcattgagaaccgaaaaactcggctccttctgtaatcagctcagggcggagaacagctgccgtgttcaccgacactttgtccgctccggcacgcagtatcgttttcatatcgctgagctgattgatgccgccgccgactgtaaacggaatggcaagcttcgcggcaacctgctccacaacgtcaaccatcgtctttcgtccttcgtgcgaggcggagatatcaagaaaaacaagttcatccgcaccttcccggtcgtacacttcagcgagttcaactgggtcacctgcatccttcaattcgagaaattgaattcctttgacaacgcgtccttctttgacatcaaggcatggaataatccgttttgtgatcatttgcgcttcaccctttcaagcgcctcactcagcgtaaactgattggtatacagtgcttttccgatgatcgctccagagacgccgtccgcctcatagcgggcgagagcttcgagatccgcgacggagctgactccgccggaagcgatcaccgatttccccgtttccttagcaagctcgaccgtgcttttaacattggggcctgacagcattccgtctgtcgcgatgtcagtaaaaataaagacttccgcaccttcattggctagctctttgcccagttcagttgccttaagggttgatgtttcaagccatccctctgttgaaacaaaaccgtttctcgcatccagtccgattgcaattttctcgccatattgtttcagcattttttttacaaacggagggttagaaactgctgagcttcccaggatcacccgatcgactcctgctgataaatattcatagacgtctttttcggaacggatcccgccgccgatttcgactttcaggttcagcttttgcgcaatctcaatcacatggcggtcattcactcttttcccttctttggccccgtcgagatcaacgagatggatccattcggcaccctctttcgcaaataactcagccatgtcgtacggtgaatcgccatatatcgtttccttattataatccccttgaacaaggcggacacatttgccgtttctcatatcaattgccggatataatgtaaaatcactcattttttcaccttctgttcttctgccattttcgtaaattgggttaaaatagacattccgaccgtgctgcttttttccgggtgaaattgggcgccgaagacgttcccttttccgactacagcaggcactcgcacaccataatcggcgcttgccagaagcgcgttctcctccatcccgtcaatgtaataagaatgaacgaagtaagcgtagccttgttctgtttcagacagcagcggagattcattatgaaaagaaagacgattccagcccatatgcggaaccttcagcttgtttcctttttcatcttctgctttcagcctgactgcttttccttttaacagcccgagtcctgaagcggtgccgttttcttcgctttcttcaaataaaagctgcatgccgaggcagatcccgagaagcagccttccctctgagagcatatcgtgaatcaattgatcaagcttcgtgtagcgcaaattgtccatcgcgtctccaaatgaaccgactcccggcaaaatgaaggcatcagcttctttcagctcctccagcttttcagaaacaaaatacggcacgccgacacgctcaagcgcctttgagacactgtataaattccccattccgtaatctatcacgccgatcatttacagcatccctttcgttgacggtattcctttaacacgcggatcgatcgttgtcgcttcatcaagcgcacgtcccagtgctttaaaaacggcttcaatcatgtggtgggtatttgtgccataatgaacgatgacgtgcaggttcattcgagcttcgagcgccagcttccacaaaaattcatgtacaagctccgtatcgaaagttccgactttagcagccgggaaatcagcgcgcatttctaagtgcggccggttgcttaaatcaatcacaacttgagcaagtgcctcatccatcggcacaaacgccgatccgtagcgtttgattccttttttatcgcctaacgcttcgagcagcgcctgccctaagcagatgccgatatcttcagtcgtgtggtgatcatctatatcaacatcgccttttgcgttaatggaaagatcgaattggccgtgtttcgtgaataaatccaacatatgtgtcataaacggcacatctgttttgatatccgcttgtcctccgccgtctattgtaaatgccagctcaatatctgtttcgtttgttttcctgacgcgttccgcttttctcatttagaaatcctccgttctctcgcttcaattgatctggcatgggcttctaacccttccagtctggcaaaagccgcgatactttcggcatgttcttcaaaggctgattgactgtaagaaataatgctcgatttcttttgaaaatcagttacgtttaatggacttgaaaatctggctgttccgtttgtcggaagcacatggttcggtccggcaaaataatcaccgacaggctcagggctgtatctgcctaagaaaattgcacccgcatgtttgatactgccaagcaaagcttccggagactgtgttatgatttctaaatgctctggcgcgagtgtattgacagtctcaatcgcttctaccattgtttccgccacatatatacaaccgtaatctctcactgaagcttccgctatttctcttcgcggcaaggtttccagctgcttactcacctcggctgaaaccgcctcggccagcgctatggaatctgtgacaaacacacatgagctgagcttatcgtgttccgcctgtgacagcagatcggctgcaatttcgctcggaatcgctgtttcatcagccagcacgacgatttcactaggtccggcaatcatatcgatatcgacatcaccgaacacctcccgtttggcaagcgcgacataaatgttgcccggacccgtgattttatccaccggctcaatggtttctgttccgtatgctaacgccgcaatcgcctgagcgccgcccattttgtaaatgtcttttatgcccagctcggaagcagcaaccaaaactccaggagacagcagaccgtcttttcccggaggcgtgacgagaacgattctttcaacgcccgctacaagcgccggaatcacattcatcaaaacagatgaaggatatgcggccgttcccccggcacatatacacccgcggaatccagcgccgtcactttctgccccagcattgtgccatcctttctgtgataaaaccaggaggattgcagctgtctttcgtgatattccctaatattttcgattgcctgcctaatcacctgaagaagacgtgaatccagtgaggtgtatgcctcctcaaattcttcttttgtgaccagcgggctgtctatttcgatgccgtcaaatttcgccgtgtagctgcgaaccgcctgatcaccgtttgctttaacatcttcaataatggaccggaccgtctttctttgttcttccgttccggcatcgatggaacgcttgagagaaagccgttccgttccgctgatggttttgatcttcattttgccgtctctccttccacaacgagagataggcgagatgccatttcgtcaatcacatcgtctttcatgcgatagcttaccgggttgacaataaagcgagaggtaatgtcacaaatgtgctccgtttcaacaagcccattttctttcagcgtctgtcctgtggaaacaatgtccactatccgatctgcaagcccaatgagcggagccagttcaattgaaccgttgagcttaatgatctcgacttgttctccctgctctctgaaataactggaagccacattcggatactttgtcgcgattcttggcgctacgccgctccagtctgtattcggaagtccggcgacagctaagtggcatttgctgatttttaaatccagtacctcatacacgtcgcgttcctcctccagcatgacatccttgcccgcaattccgacgtctgccacgccatgctccacatacgtggttacgtccatcggcttcgctaatatgaaacgaagattttcctccggcacatcgatgatcagttttctcgaatcttcaaactcctcagggagcctgtagcctgcctgcctcagcagccctgccgcttcttcaaatatccggccctttggcatcgccattgtgagtaacttacccattttgctcttcctttctggcaccgataaaataagtgacgtttgcaaaagattttgtcatctggtcgatattttctattcccgataaatcttgaagaaccactttgttccctttcatgcgttcttcattcgcataagcgatagcttgcgcccgctgctctttgctgaaaataacagcgtctatatcaaaaggttcttctttcatatgaagggcttcaatcagccggtcgatccgaagcccgaagcctgttgccggcgcaggtgaatcaaaatggcccagcagcttgttgtaacggccgccgcttcctatgacaaaaccgacattctcggcgtacacttcaaataaaatccctgtgtaatagctcatgtggctgaccatattcagatccaggcggacattttccgtacatccgtaatcctcaagaatgctccacagcgccttcagctcatcaaccacgctttttccttgcgcagaatcgacgatttcctcggcacgtccgcatacttctataccgccccgcagttcaaggagctcaagcagcctgcttttatcaatggaggaaagcgggagagacttgacatgctctctgtagccgacgtagttcttttcatataagaacctccgcagcacatcagctcgttcaacgtttccgagcacctcaacaaacaaagcatccgcaatgccggcatggccaattgcaattttaaaggatgccagcccagcgtttttcaatgccccgacgactaaagcaatgacctccgcatccgcgctcgtcgtgccgtcaccgattaactccactccgacctgctcgaactcagccggacgcccgccttcacgctcctgagccctgaatacatttgccgcatagccgactcttagcggatgaccgtgtttcaaaagcttcgatgccgccacccttgcaatcggccccgtcatatccgggcgaagcaccaatgtcttgccgtcctgatcaagtagcttaaacagctgctgctcttcaattgctgactggacgccaacggtatcgtaaaactccagtgtcggcgtttccataaattgatatccccatttatcaatcaaatcggttaacgatcgtctcaccttttttttcgtttcgtataaaccaggcagtgtatctctcatgccgtgcggtttttcaaacataaacatcaacccgagcacctccgctgttatcttatgaaggaaaattccgaatcctttagttcgctaatatgataacatgttagcagatgaaagaatgaaaatcaacgcttaacttcagtaaggatatttttagttcaaatatccttctcctcattatgaaaaaatcatgaataatgtattaaaggtacgtaatatctcaaattctttatgtttggcatgctataatacaaatcaaatagagaacaaggagataaagatgaaaacactgcgaactctatgtgtcctgatgattctttcaggcgttatttttttcggacttaaaatagatgcaaaagatatagatattccttttttgaacagccttaaaaaagtggtttctgatagcgatacagactcagctgcgaatagcaaaaaggagctgaagggaagcgcaaaaccgctggatgtcatcctttacaatcaaatggacgcaccccggctctataacggctgtgaagtaacaagccttgcgatggtgctgaattatgcgggatacgacgtgacaaaaaataccctggcaaatcaggttgccacagtgcctttgacatacagcagcggattaaagggtgatccgaatgacggatttgtcggggatatggcgaatggccctggtctcggtgtctaccatcgaccgatctatcagctggcgaaaacctatgcgggagacaaagtgtctgatctgactggaaaaagtatttccgctgtttatcagcagcttgaaaaaggcaatccagtttgggttattacgacagccaactttacgccagttgacaacatgcagacatggaaaacgccaaacggaacgatagagattacgtacagcgaacacagcgtcgccgttacgggatatgatgataaatatgtgtatctcaatgatccgtatggctataaaaacagaaaaaccgatagaacaagctttgaaaaagcgtggaaacaaatgggcagccaggccgtggttattcaaaagtaaacacctgaagcctcactatgctctatcctgagcaaatacgacaatattcatgctttttgtatcaatcggtaagatcgattcattttccatttttcacccaaaattgtctttactttcaggctgtctgtttttatgattaaagcagattcagccttgccccgatctatgcgagagaagccggtgcaagtcgctgacgcttctcttgcaaaaaatgaaagatatccggggaggatttatcattgaaaaaaatcgtgtctatcctatttatgttcggtttggttatgggtttcagccagtttcagccatcaaccgtttttgcagctgacaaagtggtgcacgaaacaattatcgtaccaaaaaatacaacatatgacgggaaaggacagcggtttgtggcagggaaagaattaggtgacggaagccagtcagaaaaccaagaccctgtttttcgtgtggaggatggagcaaccctgaaaaatgtggtgcttggtgcacctgcagctgatggcgtgcacacttatggaaacgttaacattcagaatgtgaaatgggaagatgttggtgaggatgcgttaacggtgaagaaggaaggaaaagtgacgatcgacggcggttctgctcaaaaagcgtcagataagatattccaaatcaataaagccagtaccttcacagtgaaaaatttcacggcggacaatggcgggaagttcattagacagcttggtggttcaaccttccacgttgatgtgatcatcgacaagtgcaccatcacaaacatgaaggaagcgatattccggacggacagcaaaacaagcacggtcagaatgacaaatacacgctactctaatgtcggtcaaaaatggattggtgttcagcatatttacgaaaacaacaacactcaattttaacaaaaaaagtccgctgatgttattcagcggactttttcaatctttcttgcatttcttccttcgtatagatgatcttcatcggatttccgccgacaaatgccccatcaggcacatccttatggacaagcgttccggcggacacaactgcgccatctcctattttcaccccgggcagaatggtcgtgttggcaccaatcatcacttcgtccccgatcagaactttgccgatccggtattcgtgaatcaaatactcatgggccagaatggtcgtattgtacccgatgattgtatttgttccgactgagatcttttccggaaacatgatatctggcatcaccatgagggcaaaggatgtctgttttccaaccttcatccgcagaaatgtgcggtacagccagtttttcatccctataaacggcgtatatctcgcaatttgaatgacaatgaaatttttgacgacctttaaaaaaggtaccgtttgatagacatgccacagtgagttggcccccgagaccggatgacgatctgtttttctcacagattacttcactccaacgatttgtaatagatcactcattttctcaagcataaaatccggctcatacttcgccagcatttccggccctttaatcgtccatgcgactcctgccgtttttgtaccggcgtttttcccagctagcacatcgtggtaattatctccgaccataatggcttccgccggctcgcttcctagctgtttcagcgctaaaagcacaggctcgggatcaggctttgcattcgtcacatcatcaagggtaacaactgtttcaaagaattcgccgattcccgtgagcttgaggcccatgttgacagtatctcttaattttgttgtcacaattcctaatgtaaagccggctttttttaatgcatccagggtctcatataccgtttcatattcagtcacgagtgaatcatgcatgtcatgattgtatgctctgtacatggcgatcatatcctcgcatttatcagggtccatcgaagagaacgtttcaaaaagagacggtccgataaacgcaaggacatcttctcgtttatacttgctcggataataatgctccagtgtatgcaaaaaggacgcgataattaattcattcgtattaataagcgttccgtctaaatcaaacagaattgtcgttacttgtttgtcactcatattgcttcctttccaaccgctgagggtttccactttttccatgtatgcgcaatagccattgtcagcagaactgctgtggtgacacgaatcacaagaagaggccagaccggtatgccaagcggaataaagacaagtgtatcttctacgaccgcgtggcaggcaacgagaaatataaatgccaatgtcatatcccgcctgctcacgccatcatcctcgacagctttgatcatgacacccgctccgtaggccagaccaatcgtcagtcccgccaccatcgtcatagacgtatttttattcatgccaagcagctgcgtaaacggagacagccacctggagaaccgatgcagccagcctaaatctcttaaaaactggatgatgatcatcagcggtatgacaattgccgccagctgcaaaacaccaagtccggctttcattagagcttctgccagcattgccagccagctgtctggcgcggcgctcttcgcagcgataaaaccgtactgcgccgtttcctgtccgccatgccaaatgaggttgatgacgatggctgacacagcggccaaaccgatgcgcaccgccaatatgacgccaattctgataccaacctttgcggcaactgtcgattcgataattaagttatgacagaatgaaagcataacagctaaaataaagacttctttcacagataaatccaatgttaaaatcccggcaattcccgcatacagattcagcatatttcccagtacaagcggaatggccgcttcaccagaaagcccgaagagactcattaccggtgtgatcagccgtacaagccaatccatgacaggggtatgctgaagcaaagtgaccaatagcgttaccgggaaaatcactttacccaacgtccatgttgtttgaaaacctgctgcaagaccggccagaaagatcttcttcatccctcatccccctttgttgacgtctactccgcgtaccgctccttcgagtatcccttgacgcgtctgaagatgatggctgccacagccaaaacaatcaatacgattgaaatcacctgagcgatgcgaagtgaatcagtcagcattaagctgtcagtccgcattccttcaataaagtatcttccgattgaataccaaatgatatagatcaagaacatctcgcctctacgcaaattcgctctgcgcagcagcagtaaaacaatgacgccgacaaagctccatagtgattcatataaaaaagtaggatgataatattgcccattgatatacatttgattgatgataaattcaggcaggtgcaggttttctaaaaaggctctgctgacagcctcgccgtgcgcttcctgattcatgaagttcccccagcggccgatcgcctggccgagcaaaatgctgggcgcggcaatatctgcaagcttccagaacgaaaggtttttcactctcgaaaacacatatcccgttaaaatggcgccgattaatccgccatgaatggcaatgccgcccttccaaatcttaatgatttctcccggatgtgccgcataataatcccattcaaaggcaacgtaataaattcgtgcgcaaataatcgcaattggaatggcaaacaggacaagatcaataaacgtatctttctgcagcccccgtttttcactttccctcatcgctatccacagcccgagcaaagcgccgagaccgataatgattccgtaccaatggacggctaacggccccagctgaaaagctatcggattgagtggttctatcgcttcattcatttaacgccaactcctattctccttgttcaccgtcttcaatgacatccgccagcttgttggtaaattgttcagcggcattcagccccatccgcttcaatctgaagttcattgctgccacttcgatgatgactgccagatttcggcctggacggacgggaatcgtcagttttgtgatttctgtatcaatgattttcatggtttcttcctcaagcccgagacggtcgtattgcttgccctgctcccaaagttcaaggttcatgacaatcgtgattcgtttattgcttctgaccgcgccggcgccaaacagcgtcatcacgttgataatgccaagccccctgatttcaaggagatgctcaattaattccggagcgtttccgacaagggtatcctgatcctcctgccgaatttcaacgcaatcatcggcaacaaggcgatgccctcttttcacaagctccagcgctgtttcacttttcccgacgccgctttttcctgtgatcagcacgccgacaccatatatatcgacaagaacgccatgaatcgccgtggtaggcgccagccggctctcaaggaagttggttaaacggcttgacagtcttgtcgttttcagcggcgatctgaggactggcaccccatttttctcagaagcgtcaatcagctcctgcgggatgggcatatctctagaaagaataatagctggtgttacatcagtgcacagagaatccattcgctgttttttatcctcttccggaagctgttcaaagaaagaaagctctgtttttccgagaagctgcacgcgctctctcgggtaatatgtaaaatatccggcaatttcaatgcctggtcttgataggtcactcattgtaatcgggcggttaattccttcttctccgctgattaattccaaattgaactgttccattacgtcttttgtgcgaacctttgccacgatatgttcctcctgttccgggctgccccgagcttgctcacaatactttcattttatcactttcgggcttgaacctaaaacagattttataaaagggggaaaacacctcagctggtctagatcactagtctgaaaaagagtaaaataaaggtattcaaattccagaaaggcggatcatctatggcagagagtcttcttatcaaagacattgcgatcgtgacagaaaatgaagtaatcaaaaacggctatgtcggaatcaatgacggaaaaatcagcacagtttcaacagaacggcccaaggagtcatattcaaaagagattcaagcacctgcggattccgttttgcttcccggcatgattgacattcatatccacggcggctatggcgcagatacaatggatgctagcttttccacgctcgacatcatgtcgtcaagactgcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcctaaaagagccggagcgcagccaaaagagtggattaggccttcggatgttgcgcttttcaaaaagtggcagcaggaggcgggcggactgatcaaaattgttacacttgcgccggaggaggatcagcattttgaactgatccgccatttgaaagacgaatcgattatcgcgtccatggggcacacggatgccgattccgcattgctgtcggatgccgcaaaagcaggggcgagccatatgactcatctgtacaacgcgatgagcccgtttcatcaccgagagcccggagtgatcggaacggcgctggcccatgatgggtttgtgacagagcttatcgccgatggcattcactcccatcctttagctgcaaagcttgcttttttggcgaaaggcagcagcaagctcattttaattaccgattccatgagggcaaaaggcctgaaagacggcgtatatgagtttggcggccaaagtgtgacggtaagaggacgaacagctcttctttcagacggaacccttgccggttcgatcctcaaaatgaacgaaggcgcacggcatatgcgtgagtttacaaattgctcttggacggatatagctaatataacttctgcaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatgaaagtaatggaatgtcaaacgtatgaagagctaagccaaaaagcagccagaataacggcagatacaatcaaagaaaaacctgatgccgttctcgggttagcgacgggcggcacaccggaaggcacgtatcgcgagctgatccgcctgcaccaaactgagaatctctcatttcaaaacgtcactacagttaatttggatgagtacgccagactttcaagcaatgacccgaacagctatcacttctatatgaacgaccgtttttttcagcatatcgacagcaagcctagccggcattttattccgaatggaaatgcagacgatttggaggacgaatgcagacggtatgaacagctagtcgagtccctcggcggcactgacattcagcttctcggcattggccgaaacggacacatcggctttaacgaaccgggaacgtctttcaagtcgcaaactcatgttgtgacattaaatgagcaaacccgccaagcgaatgccagatattttccctccatagacagcgtgccgaaaaaagcactgacaatgggaattcaaacgatactctcaagcaagcgcattcttctgcttatttctggaaaaagcaaagcggaagctgttcgtaagctgttagaaggaaacataagcgaagattttcccgcatctgctttgcacctgcattccgatgttacggttttgattgatcgtgaagccgcgtcattaagaccttgaaaggaacatgctgacttatgaatatcaataaacaatcgcctattccgatttattatcagattatggagcaattaaaaaaccaaattaagagcggagagctgcagccggatatgcctcttccttctgagcgcgaatatgccgaacaattcgggatcagccggatgacagttcgccaggcgctttctaatttagttaatgaaggcttgctctatcgcctgaaggggcggggcacctttgtcagcaagccaaaaatggaacaagcacttcaagggctgacaagctttaccgaggatatgaaaagccgcgggatgacaccgggcagcaggctcattgattatcagcttattgattcgactgaggaactcgcggctatattaggctgcgggcacccctcctctatccataaaatcactcgggtgcggctggcaaatgatattccgatggcgattgagtcctcacatattccgtttgagcttgcgggtgaattaaacgaatcgcattttcagtcgtcgatctatgatcatattgaaaggtacaacagcataccgatttcccgtgcaaaacaggagcttgagccaagcgctgccaccacggaagaagcgaacattcttggtattcaaaagggagcgccggtcctattaatcaaacgaacaacatatctgcagaacggaactgcttttgagcatgcaaaatctgtatacagaggcgaccgttatacatttgtccactatatggatcgtctttcataaaaaaaaagcctccaaccctttttaaggattggagacatggcgaaaatcaaactggtctggtgctggacgatatgtctcttttttcgtcttgaacttccagatcggtgatttcgttttgccgttaaaactgtcttccactataatgtaccaataataaacagactgcggttgaagatgatcccagcggaattcagctgtgtccccgctcttcacttgctcccgttttccgagctcttcattggtatatacgttacattcaaaataatcggtttccacctttttgattcttggcttcaaatcaagcgaaagggaaaattcatccttgttgccataggtatccgtatcatagtagttcttatcctttacatacggagagtacgtcgatacgtgcaccatgtcattggcttggtcaaattgaagcaaacgcaaatacccttggccgccttctggcccgccctgataatcggccagcatttgatgcacaagacgatccggtttcccatcaccatcatcatccagctcatctgtttttctcatcgcactatgataatgcccgctcaacaccatcacgacattcgggttcggctttacgatttctttgaatattttctctccgattgggcttctgtttccgctgaccagcaaatactcatgaaaagctaaaatggccatccggtcaggatgcttcttcagcacctgattcatccacgcgatgtcttcatccgtaatgccccatcccatgtacagcatgatataatcattgccgttgctagaaatcaggtcataatgtccgcggttgtttttataggaaccgccataatgcaattttttatcaaaacgatcgctgccaaaatatttgccaaacgccctgtaggagccgtccttatgcccgacatcgtggttgccggccagcacgccgtaaggaattccgctcttatccagaacggacattgaccgatcagcgtttttccactgtctgatatcagcggaatcatctacaatatcacccgtgtggaacacatatttgatattgagctgcttttgattatcttttatccattcggtctgtttatcaaaaatatgcggatagctttcggcgtaatactgtgtatcagacatccagacaaatgtgtacatatccttcgcagggggaatttcatcctgtacaatcacattcattttcgactcccgtacaaaatcggcggcaatcacagatgctttcagcgtaaacggtttgtcatccttcgcgacgaagctgtcaacaggctgccattcgtttgtccgataattccaagcatacatcgtcacctttctccccggcaaagaactgcccttccagactgcttctgccagatcattctcatcaattgatggatcaaccgtcacttcaaagcgatgataagggaaacgctctttgttttctgtcgatactgtttttccatcagcagcagatacccgctccaattctttattcgtaaatggggtctcactttccggcacaaagcttttcggcggttcagtcagtgacgcgtgcttaaatatttttacatgatttcgcgctgtatattgaaatcccctataaaaaccaacatccatggcgtcattcgtcggatctttcacccgtacagaaagcttagccttatgcgtgtcggcttcgctgtctataacctccggctggtccggatgctctcgttcggttttaaacgtcctctcaatcactgttttattgcccgcgagatccgttgctgtcacttttagagaatgttttcccggcaaaaggtcagaagatgacgtatgatatgggagtgtaatgctttctccatctaaagacgccttcgcttcctcaattttgctccatttatcatacatatccgcctgcaggataaggtttcctttatacgtttgcccctcggtgatattcggctcaatgtgaggtcctgaattatctacccgtacaaccaggctgacattttccttgccgtcgcttgcttgaatatggtgagcgccttcagaaagctttgatgtatcccactccagcagctgtgatgtaaacagtccgtcaggcagattgaactgaaattgccagcttttattcgagcgctgattatcgccaataaagagttccttctcaggggacaccctctgatccctgatcaccgttccatccgataacaccaatcgggcgtttttgactaagaagtcatcacggttttcagccgtatcaaacggggacaccttcgaacccgatcgtatcgtaatacgctgcagctgcttccctttccgaagcagtgtctctggcaatggaacagaataggtgcggtatttatttgttgtatcatcgaacacctttagcactttgccttccatcgttaccgcgtttttaaaataaaggttcgttttcctcgtatcgaatgcaaaatatacttctttttccatcgcgggctctgtcacttgttttttcccgtcaatccatagcttaatgcggtcagctcgcccttctgtcgtggctttgagaaattgagttcccgacagcgtgtctctgttttcaatattcatccgcagaccgtgcgacttgcttgtttgtttaatatcaatcattttgaccggcgttctcgcttcattgatcccgtccccggccgccacataatactctagctgatccttcccgatcaattcaggcgaatacacaatataatggtagagattatcgttgcggtctttttcagcaagaattcgcttaaacggtttgttctcatccgtccggtagtaaaaggccgctgttttcactagacttcggtcccgtatgtcagcccgcagttcaatgctttcagcagggcggacaggcttgcggtcagttaaatcctcaatgaccggcttttctttatcgagcttgattttccgtttctgctcgggcacctgtgcctgtaatacggttccgggagatggattcttttccccgattgaaatgttcagaagttctgcggttccgttcagcggatacttataaagcactgatgacagccggcgcagcgcatgtttccgataatgcgcaaccgaaatgtcctttcctgtattcgttgatatcacaacggcccgcggcctcgtattggccataccctctgtctcgtctatcaccgcgagattttttccttcttttagttgtgtctgataataacgattgaaatcctctgacgtcaattctggatgcccggcaggcttcagccagacgacaaacgtttcgccggatggtatcaagatcctttcatcaggtctccaaatcagatcggagtcaggcccttcttttgggtagcggtaacggatatggtagtctttaaaatcaatcgttctgtcagtcgtattaaaaatctcaataaattcataaccatctgcgcgtcctatattcttcgtatcaaccgccagctctgtgatcagaagctccggaatatgggcaaggtcagcctggtatccttcaagcttcagtttcttcgtctccgacttcaccctctgcttcccattcgacatcacaatgtaatactcaagctcgctgttccaaatcaaacgtttcggaatttgtgccaaaaacttgcggaccgctccggggtcgggtccatcggcaccattttgtagcccagctcattactttgtttataaaaaagaaaggcggaaaatgcttgatacgaattatcgcgaacttgagcctcaatcattagattgcttctcatttcagctttcacatcaatttgaggaggattttcaagcaagggtatgtaatgaggcgtttgaaatagttcctgctgtacaacaggaacagctttcgattcatgatggccgccagacaaaacggaaagaaaagacagtaatatagaagcaataaccgtgtatttcctcatcaaagcacctcccttttcatgtattttgcgtctgaacagggaagcttatgagttcatttttaaacaatatccaatctgacaaagcagatggtatacgacatatacgcgggactgctgacaaaaagcgaacacttcacttcacaattttttaaggaggctgcagaacatgtaaaaaagctgcctttgcgggcagcttttttttatttttttctaagcggctctaaaatgcctttttgaatcagcaaatggaagaccgacaggataacggatgcccatatcgctgtgccgaagccgtcgatttgaaagctgtcacccataatggacgcggtcatcataagcgtgatggcgttaatcacaaacaagaagagtccaagcgtcaccatggtgaccggcagtgtaaagataattaaaagcggtttaatcagcacgtttaagatcgataaaatgaggctggcgataatcgctgccccaatgctgctgatatggatggagtcaatatatccatcaatgacgattaataacaatgcattgactaaaatgctgactgcccattttaccatgtcatttcatatccctttctgacgggacgataaaaatccaaatgatataaatgagcaaaaccggcaagacacttgtcataatggctaagatgacagttatgactctgaggagtgatgcgtcccaattgaaatattccgcgagacctccgataacaccggcgattttcttatttttttctgagcgataaagcttattcattcgatcacctctgtgagtactttagtttgatggcgcctgttagtgattctgagaagacggtgatgttttgatcatgtgcctgatttgaagtgaacatcatttctttttgaatggtatcatttttttccttcagcatctcaacatccattaattcatgggacagcgaaccaagattgcttttcagctctgccttcactgcgagatcgtccggaatcgcaagctccacacttccagtcgttgtttttgcataaatggagcggcagtctgattctgttacgttaatcgcaatatttccgttaaagctttgaacgtcaatggattcgcttttccctcggagatcgatcaatccgttaatggtttccgcttctatcgttccgcagctgtggctggcgagtttaatttgcccgttggccgtttcagctatggctttttcggctgttaagtgcgagaacgacagcacgccgtttgtcgttttcgctgagaactcttttacatgtaaatgttcccctctgaccggaccgttaaacagcttcacccgaatcttatcatactccttctgaggaatatacaaagtgacattcgttttcatcgtctttttctcagtacggataaaaaatttatttcctttgatttcacattcaatatgctgaagaaatgcgtgtctcgccgcatcctggctgtcagcgcgatataccttcgcctggcattccgctctgatatcgtcatcttcccaagggacgatattcacgctgccattcgcaatttgcagctcaacactggaaaagtcagtatctttaaattgaaaaatgtgctgaacatcatacgcatggccaaagtttaaatcaaggtcaacttccttgacctttttcacagcagaatcaatccagtcaaacagcttggctcctaaagacggcttgccgctttctttttttgccgttgtaaatggctcttcctcgtcatgaacgtgaactgagagcgctgtgattttctcttctttttccttgtagtcgctgtcaagcttttcaatcagtgtcaaagcttcttgtgctgtaagctttccttcctcaacaagcttaaggattcgttccttttcttgcatcattacgatctcctccccattgtctacttatgctgcacgcaggaccttaatgccctgaatcacattccaaatgataatgccaatgacaaccaagaaataaataaccgctccccaatgattacaaatacaggaagcaagctgtctccatcaatcgcaacggctccgccaagtaaagcaataaaaaggaacagccagccgacaaacggaactatgtgagaaataagagagcgtatcgcatggcgttttgtttctttctcatttacaacaaaataagcgacaatcggcacaatgattggcgcaataaacacactgaaataacaaagtgatgcaataatagcttgattacggttcaattcattccacactcctattgtgaattgtccatgacaaaagatcagggacgttttacttatttatacgtttaaaatctcttcaggtttcaaattcattctttagacatgctccgatttacggaaattggattttaaaaagttttagaagtagaatcttccggctataccgattacaatatgtaaaaagcttacggcaaccaaggaggctggacaagcaatggagaaagatcccagtgactatacagtaacacaagaatcagtgttaaagctgattcatgaacaaaaaagaatgaatcgtgaaatgatcgccgagcttgagcagattcacggacccttcccgatctctcacgatatccaatatataaaagtgctgctcgacagcagcaacacgcatattgttcaagatttaatgagtgtaagtaagcagctgtataagaagactttgtaattgcggaaaacatatcattcattataactgaaacaaagctaaaggttagatgacaatatcttgccttttttgttttgaaaaaacaagtgattccctggctgtcacaaaatgattgtaacaaaaaaagcctgccggcacatccagttaatggactctgtcggcaagctgtaactatcagaaagagatagccgttcaaaattaacgtaacaattgaagcacgttttgcggctgttggtttgcttgagcaagcatcgcttgagaagcttgagaaagaatgttgttctttgtgaaatcgctcatttctttcgccatgtcaacgtcacggatacgagactcagcagctgtcaagttttcagaagaagcaccaaggttgttgattgtgtgctctagacggttttgtaccgcaccaagtttagcacgttggtttgagacattgttgattgcagtatcaatactttcaagttgagtatcaaaaggagtattagcaaaatctgttacattaagtgcgtttactcctaaagcagttgatgacatgctgtcaatgttaactgtaagctgctggccagcatttgctccaatttggaaagtgaaaccatcagtttcagtaccatctaataactttttgccgttgaattcagtacgatttgaaatgccatcaacttcctcaataagcgcatccatttcatctttaattgcaccaagatcttctgcttgctgtgtacctgtgtttcctgcttgaacagtaagttcacttctaaacctattatgccgtaaagaaaaagcttgcctgctaagcccaaggatggacttgctgacaagctgtcccctcttaacagagggttttaagatgtagctgtttctttcgctttcaagagcgatttcatgcgtgttttgtcacgttcgataacaggcttcaaataacggcctgtatacgattcttccacttcagtgatttcctcaggcgttccagacgcgacaatggttccgcctccggccccgccttccgggcccaaatccacaatgtaatcggccgtcttaatgatatcaaggttgtgctcaataaccagtacagtgtctccgttgtctgccaaccgttgcagcacgacaagaagcctggcgatatcgtcgacatgcaaacctgtcgttggctcatctaaaatgtagagcgtgcgtccggtcgagcgtttgtgcagctctgacgcgagcttcacgcgctgcgcttctccgcctgacaaggtcgtcgccggctggccgatcgtaatataacctaaaccaacatcataaagggtttggagcttgcgtttgattttcgggatattttcaaagaaagaaagagcatcttcaaccgtcatatcaagcacaccagagatgctttttcctttgtacgtcacttcaagcgtttcacggttatagcgtttgccgtgacacacctcgcatggaacgtatacgtcaggaaggaagtgcatttcaattttaataatcccgtctccgcggcaggcttcacatcgtccgcccttcacgttgaagctgaaacggccttttttatagccgcggaccttcgcttcatttgtctgcgcgaatacatcacgaatgtcatcaaatacaccggtgtatgtcgcagggttggatctcggcgttcttccaattggcgcctggtcaatgtcaatgactttgtctaaatgatccaaacctttaatctctttatggctgccgggcttcgctttcgctttatgaagcttttgcgccagcgccttatgcaaaatttcattaacgagtgtactctttcctgaaccggaaacacctgtaactgctgtaaacgtcccaagcgggaacttggcattcacttttttcaggttgttttctgaagcacctttaatttcaatgtaacgtccgtccggctttcttctttcaggaggcaatgggataaactttttccctgataaatagctgcccgttaatgagtttggatcttccatcacttcttccggcgtacccgcagatatcacctgtccgccgtgaatgccggctcccggtccaatatctattaaataatctgctgccatcatcgtgtcctcatcatgttcgacaacaatcagcgtgttcccgaggtctctcatatttttcagagcgctgatcaagcggtcgttatcacgctgatgcagaccgatagacggctcatctaaaatataaagcacaccggataagcgcgagccaatttgagtcgccagcctgatgcgctgcgcctctcctccggacaatgtacccgctgccctgctcaatgtcaggtaatcgaggccgactttgtccagaaagcttaagcgctccacaatttcgcgcaaaatcaaattggcgatctgcatatccttctcagaaagggtaagatctttaaagaaggcaagtgcgtcggcgacagacagctcggtaatttttccaatgtggcggccgtcaatcagtacggcaagcgcctctttctttaaccgatagcctttgcacgtcggacaagacttctgagacatatactgctccatttgctcacgtatgaaatcggagcctgtctccttatagcgtctttcaatgttgcgcaatacgccttcaaattgaatttcaccttcgcggatttgtccaaaatcattttcatatcggaaataaatcaggtcatctccgctgccgtacagcactttatccagttgatgcttcggcaaatctttgaccggcacatccatatcaatcccatagtgggtacagactgcctcaagcagctgaggataatattgtgagctgatcggtgtccaaggggcgaccgcattctccttcaatgacaaatcttgattggggatgacaagatcggcatccacttcaagcttcattccgagaccgtcacacgtcggacacgccccgaacggactgttaaacgaaaacagacgcggctcaagttcaccaattgaaaatccgcagtgcggacaggcatgatgctcgctgaacatcagctcttcctcaccgatgacatcgatcataacccgtccttcacctaaacgaagcgccgtttccaatgaatctgacagccgggctgccacgccttctttcacgacaatccggtcaatgactacctcaatggaatgcttcttgttcttttctaattcgatatcgtcggaaagctcagccatctcgccgtcaattctgactctgacatagccttgtttcctaatctgttcaagcactttgacatgagcgccttttcggcccgagacaatcggcgccagcacctgaagcttcgtccgttccgggtattccagaattctgtccaccatttgctcgatggtctgggatgtaatctcaattccgtgttccggacaatgaggcttccctactctcgcatataaaagacgcagataatcataaatctcagttaccgtaccgacagtagacctcggattgcggctcgttgttttctgatcaatgctgatggcgggagagagcccctcaattgcatccacatccggcttatccatttgccctaaaaactggcgggcataggcagacagcgactcgacataccgtctctgtccttcagcatatatcgtgtcaaaggcaagggaggatttacctgatccggacaaacccgtgacaacgacaagctgatctctcggaatcgttacatctatatttttcaggttatgcgccctggctcccttcacctctatccgatccatagccatttgttcatcatccttccgcttttagctctaaaagtaaatcgcgaagctccgcggctctctcaaagtcaagcgccttggcggcttccttcatttcatgctccatctgttcaacgactttctggcgttctttcttcgtcattttcgacagcttcggcgcggcttttgttttgtattccgctttatcctcagctgctactgtggcacgaatgacatcgcgaatttctttatttatcgttttcggcgtaatgccgtgctcttcgttaaaccgctcctgctgctcgcggcggcgttttgtttcattaatcgcaatttccatagacttcgttattttatcggcgtacataatgacgcggccttccgcatttctcgctgcccgtccgatggtctggatcagcgaccgctccgaacgaaggaaaccttccttatccgcatccaaaatcgcaacaagggatacttcgggaatgtccaaaccttccctcagcaggttgatgccgacaagcacatcgtacttgccaaggcgcaggtcgcggataatttcaatccgttcaagcgtcttgatctcagaatgcagatagtttactttaatgccgatttcctttaaataatcggtcagatcctctgacatcttcttcgtcaaagttgtcacaagcacccgttcattccgctcgattcttgcttgaatttcgccgatcaagtcgtcaatctgaccttcgattggacggacgtcaataagcgggtcaagaagccccgtcggacgaatgatctgttcgaccatttcatctgtatgttcaatctcgtacggccctggtgttgctgatacatacacgatattgtgcatatgcttttcaaattcctcaaaacgaagcggacggttatcaagcgctgatggaagccggaagccgtgatccacgagcacctgtttccgcgcctggtctccgttaaacatgccgcgcacctgaggaattgtcacatgcgactcatccaccacgatcataaaatcgtctgggaaataatcaagaagcgtatacggcgttgaacctggaggccgcagagtcaaatgtcttgaatagttctcgatgccggagcagaaacccatttcacgcatcatttcaagatcatatcttgtccgctgctctaaacgctgcgcttcaaggagctttccgttttcatgcatgaccttcagctgctcctcaagctccttctcgatattttgaatcgccttctccattttctcggcccgcgttacgaagtgggatgccgggaaaatcgcaacatgatctcggtcgccgagaatttctcctgtcagcgcatctacttcccgaatccgttcgatttcgtcaccgaaaaattcaactctgacacaatgctcatcacgggatgccggaaagatttccactacatccccgcgcacacgaaatgtaccgcgctgaaagtcgatatcgttgcgggcatattggatgtctacaagttttctgagcagctcgttgcgctcaatttccatttcactccgcaatgacacgaccatttcccggtattcctcaggcgaaccgaggccgtatatacaagacacactcgcaataataatgacatctctgcgctcaaacaaagctgatgtggcggagtgtctcagtttatcaatttcatcattaatactagcgtctttctctataaatgtatccgtttgaggcacatacgcctccggctgataataatcatagtagctgacaaaatactcgacagcattgttcggaaaaaattccttgaactcactgtaaagctgtccagcaagggttttgttatgggcaatcacgagagtcggtttattgacttctttaatcaaattggacaccgtaaatgttttcccagttcctgttgcacccagcagagtctgatgcttcttgccctcctgaattcctttcacaagcttttcaatggctttcggctgatctccctggggctgatatttcgagactaactcaaagcgatctttcacaaaaataagcctccgtttctttaacgaaatcttcctatagatatagtaacacaatggaaagcaaaatcactaaaaatacgaactaaagttcggtggttttttatttccagctgtttttgtgtataaaaaacctgcttttaaaacgtaaaagcaggtattcggtctttatattcattatgtccgatttattcttcttttttctctgcagcttttttggccatatacagtccgccagccacaagagacacaacatccaatcctactataaaatacgtttctgtatagccttttaaataagaggcaaacagcaatgcagctgttaaagcgatcgccacataatgattaaaggtgactctagtaaatagaacaacaagcataaaagggaaaaacaatgcaaaaacggcttttgtaatcaacaaaaaccctcctcagggattcttcatctgatctgattatagtaaaaaatgaagaatcggacaatcgtgcattcgctccctctactacaccataccccttttcagccaaaatcaatcaccatatttgcattttggtaccggtcaaaacttattccatggtgccgctgttctaatcagcggcactttttttattacatcatcaagtccgccgccagattccgagaataaaagaaaataggcatacagtaccagtacggccgcatttttcatgataatctaactaacttaactattcattttatttaggactttctgcgtttgacagcattttcctgaaaacctacaattgaatgatagtgtttactatcattcttttaaacacaggctccgcaataaaaagactagagagaaaaacaaaatgaatgaagaaaagaggggtttcaaatatgtattctgttttatttcgccaggcagaagagtccagccagctggctggagcaaaaggaatgaatttgattaaattgaccaaacacggtcttcctgttccggacgggtttattattcaaacgaatgcgctcgcacgttttatggaggacaaccagcttcaagagactagtgaaaacgtcgaaagcgggatcatttccggaacattttcggatgagctgaaagatgagctgactagttccttttataagcttagagaatcatatcgatccgtagccgtgcgttcttcgtctgcctcggaagatttagaaggcgcctcattcgcgggtcaatatgaaacctacttaaatatcaaaacagaggaagagtttctggctaaagtgaaagaatgctgggcctcatttttttctgggagggtcagcagctataagaaaaaaatgaacaatcaaatcgcagagccgttaatgggaatagtcgttcaggggctgatcgattcagaaatgtcaggtgttatcttcagccgcaatcctgttacccatgatgatagagagcttttaatcagcgccagctacgggctgggtgaagctgttgtttcaggaagtgttaccccagacacgttcattgttaataaatcttcgtttgagattcagaaagaaataggtgcaaaggaaatctacatggagtctgcggcagaaggaattgctgaaaaagaaacgagtgaagacatgcgcagccgtttttgccttacagatgaacaagtgattgaattggctgaaatcacaaaaaaaaccgaagacctgtacggatatcctgtcgatatagaatttggaattgctgatcatcaaatataccttctgcaagctcgtccgattacaaccattgatcaggacaaaaaggcggcagaagaaaaacgcagcttcatgattaccgacactgatatgaatgatttctggcttaacatggagtctaatattgaaggtccggtgagtccgttattttcatccttcatcgtgcctgcgttggaatatggcttgaagaagagcatgcaaaagtttccgattggtgtagttgttgatgaagtaaaactttatcgcggacatatttattccaaaaaccaaggcggacagcagcctccttctgaagactgcggcaaagagcttttcccgattttatcggagcatatgtatgacatcatcaatcacacatacctccctttttaccgaacactggaccagctcgcacaaactgagcataacgcagaaagcgcactggatgcttttcaaaaactaaaggccttttatctcacggcttatgaagagcacttcaatatcgttttcccgcaaatccttttaacaaacaaactgcaagcgatgtatcaggacattcaaggagagtccgaaaatgcccatttttacgagatgctgacaggaaaaatgaacaaatcactggaaacggaccgttgcttatggctattttctgtggaagttcaggagaacccgaaccttctggccatttttgaaaacaacaagcctgaacagctccaggagaaattggaacaaacagatgagggaagacacttcctgaagaacgtccatgaattcttgcaagaatacggatggagatctgttaaaagtcatgatctaattgaacaaatctgggtggaaaatccgtatttcgctctggccaatattcaaaattatgtccgtaatggctatcattttgacaatgaatttcagaaaacgaaagaaaaacgagagaaattatacaatgaattcttggaaagcatagaagatcccggtttgcgcaccgaatttgatcgctattatcaatggacactgaactctgcaaatataaaagatgatcaccacttttatattgacgccatgctggatgccaaggcgagaatctttctgctgaagataggtgaattgcttgcggaaaacggtgtcattcaagatcgggaggacctttggttcttatatgatgacgaagtggaacaagcgcttcttcaccctgtatccctgcaagaaaaggctgaaaaacgcagacagatttttcatgagtatgagctggcccaagccccggcctacctcggcaccccgacaaaagaacagctcaaagcagctgaagaaattgtcggcgctgtgatagaggatgaaaaaaacacagagaatcatatttttggcattgcggcatcaagcggcattgcgacaggtccggtgaaaatcattcgggacgccaatgaattttctcaattcgcgcctggggacgtactcgtttgcaagatgaccacaccgctatggaccagcctgtttcaagacgccaaagcgataattacagacacaggcggcattttgtctcatgctgcaattattgcccgtgaatacggcattccagccgttctcggtacacgcacggcaaccgaaagactgcgagacggtgacatcatcactgttgacggaagcagcggcaaaatcacagttgtcagccggtcctgatgcgtccccctctttcttatacaagcggggcgggtgtatacttgtcctgccagtatattcgtgaggtgaaacgtattgagaccgacaaacaagagaatccttgacgctgccatgcagctgctcgtcaaaaaaggatatcgcgcaacaactacaaaagaaattgcagaaaaagcaaatgtaagtgaagcgacgattttcaggaactttaaaaacaaacaaggactagttgaggctttgctttctcagcattcttcaaacagaggcagcattttggaacaaacagaaggggatttgtacaaagacctgcttcatatcggaacctgtctcttggaggagctcgaacatagaaaagatatcattaaaatcagctttcgtgaaccggccatgtttcaggatgtcattaaccacgtcactgaatatccccaatctatgaaacagctattggttgattatctcaaaacgatgggtgagaaaggggttattcagacaggaaatgaagcggagaattccgacgtgttcatgtcgattatcttcggttatttcattcaccgtctccacttaggagaccgggtcatatcaatgccccaggaaaaaatgctggagcacagcacagctctatttgtcaaaggaatttctgctgattaactccttggcataataaaaaggaggatcccaatgagctcaagaaaagaatgggcgctgatcgtctcgctattattgggggccattctggttcccattaactcaacgatgatcgcggtcgcgctctcatctatttcccatacgtataacgagtccatcgcaagcatcacttgggtggttaccgtttatttaatcgtgatggcagtcacacagccgattgcaggaaagctcggtgacatgtacggcaataaaacaatgtacttatggggagtcggcctttttctaatcgcatctctaggctgcgccctttcaccgagtctgctcctgttaattgtctttcgggcattgcaggctgtcggcggggcattgcttacgccaaacagcattgccattatcaggcatgttgtttctgaaaaacgcctaccgaaagtgtttggatttttcggactgggcgcgggacttggtgcagcactcgggccttttatcggctctatactgattgacagcttcagctggcattcgattttttgggtcaacatcccgttcctcgccattgctttatttacggcattaacgatgtttcctcaatataaagaaaataaatctgacgcgccgctggatatcatcggctctctcttgcttgcaggcagcatcgtttcaattatcctgctgacgaaaaatgaggctccgtggggatatgcggtatacagtgtattgatacttctttttgttccgctttttttcagaagagaaaaacgtacccagcaccccatcattgactttgcactgtttaaaagctcaacctttacaaatgcgaatctatcagtcttgttaagcaatttgatgatgtatgccgtcttattgattatgccgttatttatgacgaaccaatttgggcttaatacatctaacagcgggatggcgctttctgtattttcgatcttcatgtcagccagcaactgggtgggagcgcagctccatcacaaatggggagccaaaaaaatcatttttctttcatttgccatgatggctggtgcgaatctattatttttgctgttaagcagctcgcattctgtcttgttcctcatgctctctcttatccttggcgggctcgcttccggagtcggtctgaccagcatgcaggtttcatcccttgccacagtagaccccggtatgtcaggagtggcatctgggattttctcgaccttccgttatttcggaagcatcatttcatcagccttaattggcctgatttcgggatatcacatcctatttatgattctctttgctgtatccatcatcggcgtttttgtttcattgggcatcaaatctgatgaaacggcacggatagaaaaaaactcagcgtaacacaaaacagcccggcatcgcatcttcctgcggtgccgggctgccttttatgatccagaagcggctgcttcgtcttcacggtcatcctttacgaagaggatgcccaattcatgatgttctccttcataagaagctcgctggtcaaaacgaatttctccattcaaaccgataatttcaagctttacatatgcacggttatgctgaagcgcttcatagaaatcagaaacgttcttaaccggtatgccattgactttcgttatgatttccccaattttcaattccagatcctcagccggcgtattggggataatcccaagcaccattaagccctgatcccttttcgagaaataaaacggagccgcgttatcattcactctttgctttatggacagaaaaatacgccctaacaaagcagtacagaccgctgcacccgcaagcggcgtccacagtaagctcgctgccccgagaactgcgacggcaagaccgagaatacaaacgcgtttcgctgtgatccttatactcgtttcaggcagcgatccctgtaccctttgtccaaatccgacaaagtaaggaatccatagaaaatggaatgagccgccgggaacagtaaacacgggccaccagctaaggtgcgattctaaaccattaccgggcacgagaaggaacagcggcaaaagccaaacccggtttgccagctgctgtccgatcggcaaaccacggctgcttacgacaagtgccggtgatgttctcacatgcgcagaacgataagcaaccgctccttcagtgataatcagcaaacctagaaacacagccacagccggccaaacaactgcaaatccttgcggaaatctctccagaaagggctctgcctgatatatttgcagtccaaaacctatcagcatactcacactgacgatatatgcagcagacatccagtttgcgcgaagagtgaacgctgccgctgcagtgataacggcaataatcgcaagtaaaccgagaggaatcgatattccgagtccacctaaaataactgacaaaagaagacctggaatcagtccctttgtatatgtaaatttcagatcatcataaatatctgctattcttgtatgaaaggtttttcgttcccgtttgattcttacatagccgaaagccagggttatgatgataaaaaaccagaaaagcgggtgtaagaagaacaagcccgcgctttttaacagttcaattccccattgaacagacactatctctcaccgcctcaagccaaacatgttactcatattctatcaaatattaaatggcttggatatcctcaggagagtttatctctcttgcgtcatccacagcgtgacattcgatagtgaaaaatcctttaaatagtggtttacatccacatccaataacccgctgattagatgcatcgacctttttatatctgtcagattaattcctaatcgcttatggtttttcattaagtagttaaaataatgtttggcgcattcctcattaatgtcatttactgattcgacattggtgtaattgaccaaatatctgctgaacagcataagaagacttagtgcttttgtagctgaaaatgttacgtcttgtgttctgtcttttaattgttccactaattcataatattttttttcacgcacaatacttgccctcttcaattgtgaacccccattttctttatacagataagcacgggccagtataagcagcagtactggagtgctaacaagcattctcgctaacgttactctttaaatacctgtcgttcagctgccattaacctgattactgttctttttagaaccttcttatattgtatgaagtaaacaaagactaggcaacttgcaaaagtttcattttaaatgcatattaactcgttagaaagtctctctcatatattgatatcgggtaataacagtcctttataaatgtttatttgtgaaaatttttttaatttcttgtcaaaaactcattttttatgtgactaatgatccataatctctttaagcacaaagaaacaggagatggaataccatctcctttaattgacaaataatgatttcaatgctgtttgaagctgcaaatcatttttttcatctgattttttcttttctatctgctgatttaatgtctctgcagtgcgagtgtcgatcacaccggttttattcagcttgttttgatcctgaaaagccataaccgcttttttcatgtctttgctgaaatagccatcctcacgtcccggatcaaagctgagaccttttaacaatacctgcgcatgcttgacgtcttcattgttcatgtccactttaagcggctctttcagctgtaagggcccggcggaaaaataatcgggctgcttaatcgcaatggtcggttcaattcctttcttatgaatccagtttccatttggcgtcagccacttgtaaagtgttaatttgatgttgctgccgtcccccattggcacagcctgttgaaccgttccctttccaaaagacgtatcgcctacaacatcataatggccagcttcctttaatgcgccggcaagaatttctgatgcagaggcactgcctttatccgtaatcacattgacagggtacgcttttttatgggtcaatgttgaaaaataacgttttttatctccattgcgttcagcaatctgaatatacggctggtcctttgtaacgaaatgcttaagaatttcttccacactttgaagatatccgcccgggttgccgcgtacatcaatgacaagtccttctatttcttttttctcaagctccctcagcgcttttgcaaaatcctctgcggtgtgctcagaaaaagtagagatggcgatatatccgacagaatgcccctgtacttttttctctgatgcaaaaaccgtttcgagcggaatctcagctctcttgatccggaatgacagctgcttcttcgttccaggccgctgaatcttcattgaaacgctggaccctttttttcctcttatttttaacacagcgtggtttaaatccttgccggccatcgattctccattgatgctgataatttcatcattaggcttcaacccggctttttccgctggcgatttcttgaatggggaaacaataataattttgccgttttccatgccaacctcagccccgatgccttcaaatgaggaatcaagagaatcagaaaattgcttagctgtctgcttgtccatgtaaacagaataaggatcatttagcgtagacagcattccctggatggctccctcgagcagcttttctctatctactttttctacgtactcattcgaaattaactcatacgctttttcgattttgtccatagctttatcccgttcagagtcagcttgtgccgtcgcgggaactgctgcagtctggggcttatccatctcaagcaggttgattcccgcatatacaccggcgcctccgaacagcatgctccctgctgctatcacagccattattttttgattcatcctttactcctcctgtatgccagactgtctttaccaaaacctagagatagtatatgtaaaggatggagatttcatgtaatcatagaagaaaaagaaggcaaatgaaaagccgtcccgaaagcgggacggctttttcactttatactcgcaggaacttgcggatggaagtcagacttccccatactccaattactgcgccgattgccaccagcactagcgaaacttggaatacaaatggattataaggaagaagagagacaaatgatccttgaacctttggaacgacccatccgatgacgtattggtaagtgctcagcaccagtgcaatcggaatcacagaaccgaatacgcctagcagcaatccttcaaggaaaaacggccagcggataaaccagtttgtcgcaccgacaagcttcatgatttcaatttcttttcttcttgcgaaaattgtaattttaatggtgttggaaattaagaacatcgccgtaaataccagaccgataattaacgcgattccaatgttgcgggaaacgccgaccactttaaacaaacggctgacctcttcttttccataagtgactttataaacatgatccattttttcgatctttttcgccacgttcggcgtatcatgcggatctgtcgttttgacgacaaacgcatcattaagcgggttttcctgatccttcattgtcagggattttccgctgtcaccaaaactgtcaaccagctggtcaagctctttttctttagatgaaaaagtgacactctgaatgcccttcagttccttaatatcgttctgaagcttgtcctgtgccttctgatctgcagtcagatcaatcaacactttgatttcaacttgtttttcagcattcgtggccatgttattcaaattcagcataatcactaaaaacacgccaactaaaatcagcgtaacggttacagcactaatggatgcaaatgtcatccatgtgtttctcccgagagatttaaaactctcacgcaagtggcgcccgagaattttaatcatatgaaccatactcccctcttgactcatcacgcacaatgataccatcttcgattgcaatgacacgtttcttcatggtgtttacgatttctttattatgtgtcgccatcacgactgttgtcccgcggttattaacttcctccagcgtcttcatgacttcccaggacgtatccggatcaaggtttcctgtcggttcatcagcaatgacaacatcagggttgttcacaattgatctggcaatagatacacgctgctgctccccgcctgaaagctggtcaggaaattgtcgtgctttatgcttcagctgcacgagatcaagcacttcaagcacccgtttcttaatgacagaaggctgttctccaatcacttcaagggcaaatgctacattttcaaaaacagtaagtttcggaagaagcttgaaatcctgaaagacaacgcctatttttcggcgcacgaaaggtatctctttttctttaattgtcgcgagatctttatgattgattaaaatttgtccttttgtcggtttttcttctctgtaaatcattttaataaaagtagatttacctgctccgctcggaccaacaacatacacaaactcgccgggatgaatggtaacagaaatcccattgagcgcttttacgccgttcggataggctttatatacttccttcatctctatcatgaaatcacctaatcttttatatcattttatctatcacacggtcatactcttcgaatgcattcgacaatttatgacccattcatttgtaaaaagatgaaaaatctgaaagttccctttttcaatacacttcattatacgtcaaatttagacataatactattacagtttcttttcattcatattgtcaaggcataaaaacatccttgccggcactcggcaaggatgtttttatcttactttttttctgacagccatttggcaataacagcggcttcgttatcatctacaagcccctttggcatattgccgcggccgtttttaataatgctttcaattttgtgttcatcgtatttgcctccgacctcttggagattaggccctgacacaccttctaaatccttgccgtggcagcctacgcagctttgctgatataattcttccccttcagatgcagtggcttccgtcttgctgccagtgtctgtcttctcttcttttgcatcgtttgatccgcaggcagccaacagaacagaaagcgcaaatccaatcattagtatcgataactttgatttcatgttgagaagcacaactcctttacgatctcttccatattataacctcgtttaagcgcgtttgaaaccctcgcccagcacctcgctcgcgtctgctacaattacaaaagctgactcatcaatctgtttgacgatttgtttcaatttggtgaattcagtttgcccaaccacgcacattaaaatcggacgctcatcgtcagtatatccgccgactgcagaaatttttgtcacgcctctgtcaatcttctgtaagacagcctccttgacagcctgctcctgctttgtaatgatgagcgccatttttgaacgattaaagccgacttgcacaacatcaatggttttgctggacacatagacgccaagcatggcatataagccttgctcaatattaaatacgatcatagccgtaacaacgatcattccgtcaatgatggcgaggcacttccccaatgacagaccggagtacttatgaatgatctgtgcagccaaggctgtacctcccgtcgaacctttccctaagtacacaataccaattccgatacctatcccgacaccgccaaaaatcgacgccaagagttcatgatgagtggcgggctgaatatcccttgtcagaaacactactagcggcaaaaacacagaacctgcaagcgtctttagtccaaatttcccgccgagcaaaatgacgccagcaataaataaagggatattaataatccactgtacatacgctgcttcaaaaccatatgattgtaaaatcgtactgatcccgctgacaccgccggcggcaatcttgttcggaagcaaaaatacattaaaggacacggccgtaatcgctgctcctatcaatatgtatacataatcccgcaaaatccacaatgttttattccgtacatccatcatatatcctccgtttcttccaatgctctccgatagcattttaatccttccctgattagatgtaaataacacccaaatacagtggtaatatgctaaagcagcagtgaaatcaaggatataaggaataaaaaaacacacccgtatgcatcaggtgtgtttttcagcttatgaaagcttagaacgcaggtaggcatcaataaacgtatcaatgtcaccatccattacagcttgaacgttccccatttctgtattggtccgatgatcttttaccatggaatacggatggaatacataagaacggatttggctgccccagccgatttctttttgttcaccgcgaatttcatccagctctgcctgctgctcttcaattctgcgctgatacagcttggccttcagcattttcatggctctttcacggtttttaatttgtgagcgctccgtttggcatgtcacaactacgttcgtcggcaagtgagtaatccgaacggctgaatccgtcgtattgacgtgctgtccgcccgcgccgcttgcacggtacgtgtcaactttaatatcctccgtacgaatatcaatatcaatttcatcgttaaattcaggcatgacttcacatgaaacgaaagatgtgtggcggcggcctgatgaatcaaatggtgagatccgcacaagacgatgaacacctttttctgctttgagatacccgtaagcgttgtgtcctttgatgagcaatgtcactgatttgattcccgcctcatcacctggaaggtaatcgagagtttctactttaaagccgcggcgctctccccatcttgtatacattctaagaagcatagagccccagtcctgtgactctgtaccgccagcaccagggtgcagttctaaaatcgcgttatttttatcatacggctcgctgagaagaagctgaagctcaaactcattgaactcttttgttaatgattttagttctttttcaagctcaagctggagatcagtgtccggctcttctttcaaaagatcatgagtcatttgcaattcttcgtgggattcattcaattttttatacgaattgacataatcctttaaaccgtttgcttcatttataaccgtttgagctttttgctgatcattccagaattccggatcagccatttgttcatctagctcagcaatgcgggcctcctttgattcgaggtcaaagagaccccctaaagtccgctaaacgagaagccatattttcgagctctgctctgatttctgataattccatttcattcacctcattaaaagatccgcaggcgcctgcaggcgccgcggtcagtaaacttgccggggcgaactattcagtacggccgcagcaatttttatattttttcccgcttccgcagtggcatggggcatttcggccgatatcaaccactttgcgaaccggtgctttctttgcttttttgttatcgtcgccttcttgcggctgatgagctgttgtttggccttgtacaacctcttcacgctccagattgttttcaatctcagctttcatcacaaattttgcgacttcgtcctcaattgattcaatcatatgctcaaacatcgcaaaaccttccatttgatactcacgaagcgggttcgtctgcgcataagcacgaaggtgaatcccttggcggagctgatccatcgcatcaatatgatccatccatttagaatcaacggcacgaagaacgataactttttcgaattcgcgcatttgctctttgccgaattgctcttccttctcattatattttgtgatgatgcgatccataatgagctcaagcatttcatccggttctttgccgaagatatcgctcttctcaagcgcaccttcatcaagataagttgtgttgataagatcaactagaccgtcaagcttccactcctcaggaagctcttctcttggcgtataggctgcaattgcgcgttcgagagaagacttgatcatattttcaacgatttcacgcaggttttcagagtcaatgacttcaaagcgctgcttataaatgacctcacgctgctggcggagaacatcatcatattgcagaagctgtttacgcgaatcgaagttattgccttcgacgcgtttttgagacgattcaaccgcgcgagataccattttgctttggattggagtagagtcgtccatgccgaagcggtccagcatcgccattgtccgctcagctccgaatctgcgcatcaattcatcttccatagaaagataaaattgagtaatccccgggtctccctgacgtccggaacgacctcgaagctgattgtcaatccggcgtgattcatgtcgttcagttccgacaacagcgagtccgccaagctcttttacaccttcgccaagcttaatgtccgttccgcgccccgccatgttagtcgcaatcgtaactgcgcctttttggccggcctcttcaatgatctgcgcttcacgttcatggtttttggcatttaacacttgatgcggaattcctttgtttttaagcagcttagaaatcaattcagatgtttcaacggcaaccgtaccgactagaacaggctgtcccgtcatgtaacgctgtgcgacatcctccgcaactgccttaaactttccttccatcgtgcggtaaattaaatccggacggtcatcacggacaacaggcctgttggtagggatcgtgacaacctgcatgttgtagatgttgcggaattcttcttcctctgtcttagctgtacccgtcataccggcaagtttttcgtacattcggaagtagttttggaacgtaatcgtcgccaaggtcatgctttcgttttgaatctcaagcccttcctttgcttcaatcgcttggtgaagcccctcactgtagcggcggcctttcatcagacgtcccgtgaaggaatcaacaataacaacctgtccgtcttccactacatagtcaacgtccttttgcatcgcaacgtgagcttttaaggcctggttgatatggtggttgagcgcgacatgcttcacatcaaagaggttatcgatgccgaacgctttttccgccttcgtcattccttcttcagtaagctgtacagcttttgttttgatatcgtacgtgtaatccttctccgcttttaacgtacggacaaaagcatttgcctgtacgtacagcttagtggattttgcagcttgtccagaaatgataagcggtgttctcgcttcatcaattaaaatagagtcaacttcatcaattaccgcaaaatgaagcgggcgctgaaccatctgctctttataaagaaccatattgtcacgcaaatagtcgaagccaagctcgttgtttgtggagtaagtaatatcagcggcataagcttcccgtttttcgtcttttgacattgagtttaaattcaagccgacagtcaaaccgagaaactcgaaaattttccccatttgctcagcgtcacggcttgccaagtattcgttgacagtcacgatgtgtacgcctttacctgttaacgcatttaaataaacaggcagagtagacgttaatgttttcccttcccctgttttcatttccgcgatatttccgtcatgaagcgccacgccccccatgagctggactttaaacggaaacatgcctgttacgcggcgtgaagcttctcgaacaacagcgaaagcttcaacaagaagatcatccgttgtcgcccctttttcaaggcgctctttaaattcaattgttttatgtttcaacgcgtcgtcagagagattttcatagtctccgcgaatcgcatcaatatcgttagcaattttttcgtatctattcagcgtacgttttgttggatcaaacattttatttaaaattccaagcatttataacgctcctctatcatcacatgcctattttaaaggcatgtataaataatttactagtccatgtatacctctcattatcatatcataccttttgttatttccaaagaatttgcaaataagaaaaacaaaaaccttccgcgaacatcacggaaggcttctcttcattattcagtcggttcaattaagccatatttcccgtcatttctgcggtacacgacatttgtaaggtttgtttccgcatttgtgaaaacaaagaaattatggccaagcatattcatttgcaagatcgcttcttcactatccatcggctttaaattaaagcgtttctgacggacaatgtccaagctctcctcctcttctatgtcatcctgaaccgcaatatctgtatcagagccaaggccgtttgccaataaatattttggagagccctgctcacggaatttacggtttactttcgttttatgcttacggatttgacgttccagtttgtttgttgcgagatcaattgcgttgtacatatcctcgttatgcacctcggaccgaagcgccagatctgtcatcggaatcgtaacctcaaccttagactccttgtcattgtaaaacttcaagttgacgttcacatcggcatccacactatggtcaaaatagcgctccagcttgccgatcttcctctcgacatgatcctttaacgcgggtgtcacttcaatattttctcctctgatgttatagttcatcaaagaacgcctcccttttattaaggatatgtatctatttctcttttaccctttacaattcctgctgaaacataaatcttttgtgaaaattcagtgaactttgtcgaattttgtttgtatttgctctgttattggcggttcggaggtatatgtatatgctgattgaacgaaacaaatacctcgcacacgcctaattgattaaaaagggttccatacattgatgaatagacagcatccattttctataatgaatcagaaaatgttcctttaaatactcacagaactcatgagagggaaaagagaaagagaccaattgatcaaactccgcaaaaatttggtcaaatgctttcacacaaatttcagcacaccgtgaatccataatgaagagaagtgttgaatgtgttgaatccaaataaaaaaaggcttggatcagatcttggtagatccgatccccttctgtttttgataaattctcttcagcctctatcaaataacacaacccttcttcaatggtaaaaagaagatgataataagctgataaaagcgtataatcttcaatgctcttcaaggcactcacctatttacgcttgtcataatatgtgccgtcaatcgtaatgttgttataaggatttaaatacgtggtatgcatcacacgttttcttttcatctgctgaagttctgctgcgattgactgcttcagtcgttccatttccttcacaataagctgatcccatgtcagcacaagcttcatctgctttcgctcttcttctgaaagcggcagagatatctcctgaatcagttcagaccgtttagccacaaagtcttcaatttgttttaaaagctcatcgctttccggcgtattttgtatgtgtgacagcatactcttcgtctcagtgtaaagttgatctatgtttttcatgcgatcccgcctgatccgtgccggtccttccgttcactttgaatggcttgtttccaagcatcgcgaaaatctgttacatagccttcaacctcagccagcatgcccgtatcatttttgatatttgcctgtaccaatcttcgatacatataatcgtacatggcacccatggaagcggaaagctctatgttacgattaagtgtaaaatttaattcctgaatgatattttgcgctttaatcagattttcatttttacgttccatatcatcattctcgatggcctgagaggcaagtcttataaatttcaaacagccattatacagcataagcgtcagttcaccgggtgtagccgtattcactgaattttgctgataggctgtataaggattttggatcgccatgtgtcatcctccaaattacatttattgtacaagaagctgtgataaataggacgcttgttcgttcattttttgaatcgcagaatccattgcactgaattttgtataatagcggttttctattgtggtcaaccggtcctgcattttggtaatatctgtgctgatcgtgtttaaatttttaccgattgaataatcattggttcccattgtcgagttgccggcttttgcttcaatgctcttcaccgtacttttcagggtgtcaccgatgcgtttcataatccctttatcactataggcgctgctgttcgacccacttgtaaataaagccgcaacgctttgcggatcttcttgtattttggctttcagtttgtcttcattaatctctaaatgccccgcatttggtaagcacttgaggttgttatgccgaattctgtcaattgataggttttcccatccgcattaacttgagtataaaagtcagtccgcatttggttcgtgccggtgctgatgctggaatcatttctaagcaatccgcttttcgccttctcctcccagagctctacctctttatcggacatggcttctttttgttcacttgtcaacggagtatagtctcggtatttttcttctttcagcttttcattcaggctgtcaaccatttcattgtatttatctacaaactctttgatttggttataaatcccgtcaacatcagtagaaacagatgtggtaacagggcctgtggctgctgttgtatttttaatcgagtaagtaacaccattcaccgtgaaattgtttgtcagcttctccatttcaaagccgttgattgtgactttggcatttgtgccttctttgtaagcagtgagcttattatcagcatccaaagaaaaaccaagctgaccggacataaagtcagctgtagcagagtctgctgcctgtatactgccccctgcacctgttgctttagaagaaaacgcaattgtttctacgtactctgtaccattccaaattttatctttaaaagctgatactccaagatctgagctgttaagtttagaaatcacattatcaatcgtatcggcgctcgtcacactaatgttcactgtttttgccgttgtttcgccaggcgcaacaacgttaaatgccaaattgtaatcgccttgagtgtatcccgtataattgtttgccttatacgttgctgcggttgccaagctcgccacttcaacagtagaagaagagtttggtgcacttgcgcttcctgtagcagttaacacagactcattagagcttgtcacagttttgctctgatacgtgctaggatatgtcaacgtatttttagacatataatcttgcaattcttttatttttgtattgacttcacgatagctgtcacgctgccattcaagagtctgctttttttgcttcagcttatcaagcggggctctttctgtctgcatcagctttgatacaatatcatctatatccattcctgacgccaaacctgttattcttgtgaccatctcaaaccactcctattctactttttttcatctacaaataacccaagaaattcagtcatagccgcataaaaatcaagccaccgttttggtggaatttcgcggatcacttcatttgtagagtcctctattacctttacatagtattcatttaacttgtcatgaagctcgaacttcagatgaacttgcgaaggttccaaaagcttgttcatttcccccaccatttcagcaagattggtatctgaaacttgatgaacaggaacctcgttatcattatctttctgattatgtatttgagtatcataacgatcccaaacaggttgtaacgtagtgagcctttcaatgttcaattgatcatcccctatgccccaatctatcgtttatatcgactaaatggagataagattacacatatttttggaaaaaaatcttctgttttagatttcttgtttggaaatacatttataaaaagttagtggagaatccggttattatatcatgagttagtgacaggatgaggaatgattcggagatagaaatataaattaaaagaccctggcaacgccaaggtcttttttaaaattaacgtaacaattgaagtacgttttgtggctgttggtttgcttgagcaagcatcgcttgagaagcctgagaaagaatgttgttctttgtgaactcgctcatctctttagccatgtcaacgtcacggatacgagactcagcagcagtcaggttttcaccagaagcgctcaagttattgattgtgtgctcaagacggttttgtaccgcacctaattttgaacgttgagtagatacattgttgatcgctgtatcaattaaaccaagttgtgtatcaaatgctgttgcatcatctttgaatgcagtaacatcgataccagcaactccaagtccagttgcactcatatcaccgatattaactgcaagttgctgccctgcgtttgcaccgatttggaatgttaatttgtcagttgcaaagtcgccattaaggagcttcttaccgttaaattcagttctgtcagagatacctttacttccacctgtcataccaccaacttcttcaagtagagatttgatctcttcttggatagcacctaagtcagtaccgtcttgagtaccagtattgtttgcttgtactgcaagctcacgaacacgttgaagaatagagtgagtttcagtcaatgcaccctcagctgtttggataagagagattccgtcttgagagtttttagaagccatttcaagacctctgatttgtcctctcattttttcagagatcgcaagacctgctgcgtcatctcccgcacggttaatgcgaagacctgaagaaagtttctccatgtttttttgtgatgcaccgttgtttgaagacaaacggttcagtgtgttaagtgctgcgatattgtggttaattctcattgttttgttcctccctgaatatgttgttaaggcacgtccttgtgcccttattttgtaactggcggagtcttttgcacctcctcccggctacatcattaatatcggattgtctctgattttgttaatacaaaaataaaaaaatcctcactttttttgtgaggataatgcggagatcacatcgctggataacgctgctgcacggttattttcttcctgaatggtcaagtaaatttctttcctgtgaatatcaatatgctttggggcgtcaattccaagcttcacttgatccccttcaaccgcaatcacttttacttcaatatcagcacctatttgaatcgcttcgtttattttccgcgataaaactagcatgattctcctccaatcggatgctttgtcgtatatgaggagtcgtgtaaaacgacttgcttagccatcatgttcttgcgattcacaataatgggagccaataaattcgcagtagacttttcgaatggctctgccatagtcaatattgtcatgacttctacgtcttgaatattatcgatatccaaaagttcagcagttgattcatcaagatcaaattcataattcttaaaaaagataaacggacttacgacgataaacgcaagattttctgaagtgacggactgcagtgccacgaatggagagtcttctgaaagcggaagtatgacaaattgtttttcttctaaaaagcctggaatcccgctttcaaaaagaatgatttgttcttcttttatgttcatttggccatggtacttcgtatgaatgatcattgttcacgatccttttctttttacttttcgggtgattctttcgggtattctacatctatatttaaatcagggtattggagcatgtcaaccttaacatttcctggcgtatattcaacaattggcttatgcggctcagcctgaatatcaggctttcgcggcgtaatctgaacatcaagctgtgacggagtatattgtattttcaccctagatagagaaggagcataattttcgcctaattgaatttggtgcatttcagagttcctccttgcttgtgaagcgattgggttacccttattttcaatcctcataagctcgtcgccttcttctgcagtacgcgctattccctccattacatcctcatgcccttgttgggcggcttcttcaattctcttgaaaacatgctttctgtctaattcttcccatgcttgtgtctggtcaatcgtgagttttccaggtgtcaccgatatttccatttccgcactcggctgttggatctcaagatcggcttgcggctgctccatttttaagctggcgggcgtcgttgttaaacctattttcccttgaacactatgcataatcaatctgggaatctgcatcactctacctcctgaactataaaaaaagcgaactcctaagagccgcttactttaaaaagtcaatcaatgtaggctgaacaatttgcgcattaacagccagagttgccctgtgcacactttgctgcgcaataaattcagttattacttcttccagctctacatcttcattgtctgacaacactttggtagctgtttcttcttgagctgaaagtcttgtattaaccaattcaagacgattatatctcgctccaagatcagatcgttcagcactcatgccgtcagaaaaatgatcaatatcatctaaaacactgtccatgccatctagcgaaccagaatttagtgctttctcaaaagaatcaagcatttcaaatacattctgcccgctttcagaagtgcctccaaaagctgactttgggtctgaattcactttcaatgacatattatttgatatattgactacgacatcagctgtatcagaaattgtataagttccgtctccgttatctgtaaccggaggcttatctgaatttgtgccattaaagatatatctgccgttcacttgtgtattcgcaatatttaaaagctgttcctttaactgctttacctctacgccaatcgcttgccgctccgactcgccgtttgtatcattttgagcttcaaccgctaattctctgacctttgacaagatgtcaattccttctgtaatgtttgtttctgtgttttcgagccaggtaaaggcttgagaagcattgcttttgtactgctgcacttgagacagttgcgtattatactttaagcttttcattgctactacaggatcgtcggaagcttttgagatttttttccctgaagaaatctgcgactggagtttatccagtttcgagtagctcgaaccgatatatctcagtgagttttgctgtatcatgccttgtgttactctcatgtgactctacctaccttcctccaacacccatgccattgatcactttatcaagcaattcgtcttgtaaagtcaccattcttgcagctgcattgtatgcgtgttggaattgaatcatattcgtcatttcttcgtctaaagaaactgcgctcatttgctgacggtttatgtcagcatcatttagctgtgtttctgtattagacgccagtcgattagcctcttgagcttctatccctagctcgccaatcagaccagcataataatctaacacactagtttctttaccgttaatagtaattttaccggttaaaacatttgctagttttgtagcatttgcgttatcgttggctgcaccagtcagtgagaaagcaatgtttgcgccttttgaatctattatgctgtcagccactttgatcttgcccgccgcgcccttggcaggttcagtttcaccgccagtaaaatcaaaaaagtctccgccttgttcaccgctcttggtcacaccatttctgtgcacttcattgaaagctttcgcgaattcaagcgccatattgtcaagatcagaaagcatttccgggtatacgcccttttcttggccgtctgctgttatatacccgtaggactctataaatcctaaaagggatcccttgctgctgaaggactccgcctgcacagctgtatctccgattgaaatacttgatactaacccagtttcattatcatagttggctgcaagttctgaaacctcgtaatttttaccgtccaaaacagttcctagcgactgtttatttttatcgaggatttcaattgatacagttccttcagcagaagcaagcgcattcccgcctgatttgttgtagctgactttgatatcaaccattgaggataatttatcgatcagcaaatctcgctggtcatataaaccattcggaagaagcccgaccggctctacttgtgcaatttgcttatttaaactgtttaattgagaaagcagagaattgacatccaacacagttgtatttagctctgcttttaaattcgattggacatttgtaagtgattcagaaatataattaaacgtttcagctacagcttgtccttttcgagcaacaacagaacgtgcactttcttcatttgtattattcgataattcctgcagggagttccaaaacgaattgagcacactgttcaagccgctgtcatccgtttcatttaaaacgccttccatttgggacagcgctttggccttcgtgtcatagtatccggcactgttgttttgaagacggtattggtagtcaagaaagatatctcttattctctcaactgattttccttgaacgcccgtacccatttgtcccgctgttttttctgcgtttttggatacagcagggaaatagtcagttgcctccaatgagacccgctgtcttgtataaccatcagtattggcatttgccacgttatttgcagtagtgcttaaagctgcctgctgagcgcttaacgcccgccttgcagtttcaagccccataaaggtagatgtcattttctgaattcctttctgctaagcttttgaatcaaacagtttcatttggctgcttttcggcagctcagctttaattgatttgctgtaattgaagttattttccttaggaaccagcatatcgtacgaaatagagatgaattgcagcgcgtctcttgtcagctgcctattcatctcatttacttttttcagacgtccgagaacttgagaaagagattcgtatagttgttccagctcttccttttcactgcctgaggttttggcgatacatgcggaaatagtattattttcgctatatccgagaaaggccgaagttgttttgatccggtcatcttctgtctgcgtgatcgcttgaatatatttttgctcttttgtcaaaatgttagaaagctcttttgttttgccggctttgagcgcttccgtcttttcttcagacagcgtgagcaggtgctcatgcagaacgcaaagtcgcttcaattgttcaataattgccttcgctgacatgggctttctccttttttattgctttttataaaaattaatcatatttttcgcgatatgatttgcgtctactttgtatgacccgttttcaatttgcgctttaagctgtgcaattttttcctgtcgtgaaccagcgactgcgtcggatgcatgttgcatttctttagcctgtgatgaaatttcaattttatcttgaggctgtgcagcagttttttgcaccgcttgcttatcataatttttttgatatggattaacggattgtgttccaaattgattgattttcataggattcctctcgctttccgttgcagtctttaaacaatcttaacccttttatcgactgcgtcttcagttagtttagggaatcagctgtttttggtattataggcatagtatgtgtcttttttactattttctttctcgattttcagagcatcctcgtggttcaaatgatccatttgatccttaatatcggactggcaagccttgcagaacttgccttctctaatcgatgtcccgcacctttcacaagggtatgccaaattagggagatgagtgatctgaattcgcttctgcctgatgaatttcaatatcagctcttcttccacacctgtttcctcagttatccggctcaaagttgattgccggttttcctgttttcttaaaaatttatagacagtctcaaatgatttttcttcttccttaatacacgcctgacatacggtttgcagctttgtttttaaaaataaagcattgcatttcggacaattagccagttctcccatctttttttctccttattagataatatgcctgtgtcaatttctagtgattatatcggcataaaaacagaatcatttagcttctgatcaaggtaaaagatgacactgaagcggcttttcctttttctaataagcagcgggctgcgaagtgcaaggtggcgcctgttgtataaagatcgtctattaaaatgatatccataccttctgctgaattattttttgtatcaaaaatgcgctctgatagcaggcgttctgttttctttttctttgactgtttctcattattcaggcgaatgaggggatggtgggaaggccggtctaaacattctgccaagagctgtgcctggttaaatccgcgctcttcttcccgttccttgctcagcggaataggtacaagaacaaaatgcttatcggggtaaaccttagaaaaggttgaagaaaaatcacttttaaatgcatttatgatttctgcatctcctctaaatttaaaacgggagagcgtttctttcatcatatcattatatgtgtaaactgaacggttttgacgcaatagcaaactgtctctgctccttgttctccacacctcgcaatccctgcatacggcatgaacagattgaggtctgccgcacagggggcagatatgtcctgtgattttctttaatttgcttctgcaagaataacaaaccttttcatcaggctttaataaaaaaagggctctccatgtaacatcttgagaaaattgcgaatcacataataaacagatcagtttatgaatgcctcctcctgcttcgtttgacataaatcgcttggactctctgaaactacagcagcagattcagccaaaatgacaagcattgctgtgtttttttgtttatctaccagctcagctttcgtatatgcgatctttttaagatcagtaacgtaggatggactcactttgtttaaagaaagtgccaatacatcgttttggcatacttggcaagtacaggccatatgaagctggtccatatatcggtcgagcagttctttcattacgatttcttttgaattgacaagcatttttacagctcctcatcatcggttatatgagtatactgtaccacgttttcaaataatggctagtctgtacattcaacttttgctgccaattcattcatttcttttatatgcttccttgcatcgagcatactctttgttttgccgaagtgaaagtaaatgacatcgccgtccgcatattctttatgccggccggttcttcctgcaatttgaacaagtgcgctttccgtaaaaataggtgattccgctcctagtacacccgtttgcaccttggggactgtgacgcctctttccagtattgttgttgtgattaataaatcgagctgaccatctctgaattgctgcactttctcctttctatgcttgtcttccgcgtgcacagatgcggttcggcaatgaacacctctaaagcacgcagcagccttttccagaatagaaacggaaggaacgaataaaaaaacaggcctcccttcttttacatgaaactctatccatcttttcaccgctggcggaattttatttcggtttaatttcttcttccagtttccacaccatacaaagcgcggttcgggtaaaggtttccggtggtgtcttgcggggatgcgaactgaatgtaactgtccgttcagtgcttttctttttaattctttaggaggtgttgcacttaaataaacgagggtgctgtttttctttcttgctttttgaacagcgaattgaagggtttgatcagcagaatatggaaaagcgtcaacttcatcaatgatcataacatcgattgcatctttatatcgcaaaagctgatgcgtagtggaaatcataagcggagatagccgccctttgtcatcgcttcctccgtaaagcgctgaaatgtcagcaccctgaaaggcagccttgagtcttggagcaagctctaatacaacatcggtgcgaggtgttgcaatacatacacgcagtccttgatttaacgctgattctataccaggaaacagcatttctgttttgccagcgccgcaaaccgcccagatgaggagctcttctttttttgatattgcttcaattaaaacattggcggctttttgttgtccgcttgaaagcttgccgtcccatgtcagtttaattgactgccagtttggttcattttcctcttcccatgaatataaaggaacctcctcactcactctgcccatcatgacacaggaacggcaatacagcttattctttccagatgagtgataaaaagaaaaataccgctgatcagtttgtccgcacctattacatctatatctccgtttatttatggatatagaattttcagcagtgatatatccattcttgatatgccattcaatcatctcatcggaaaatgagagctcagtcctgagcaaatgacggcttcgaagcgtctgctgcaattcttttgaaaaggaactgtttttttcaactggcacattcacatagcacgcctcctttcgagacagtatgcctgaatgaatattttctgtccaacaatcaaaataggaatataaaaaaatctccgctctaaaaacggagatttggccttatttaaaacaccagcaaattcctagcgcaccttcacccaaatgagtgccgattaccgcgccaaaatagctgttataaaattcaacatgaggatattttacagaaagctcttcaatgattttcgctgcttcttcctctcgattagcgtggataacagcagctcgcataggcagccctttactcgcatcttcgtctaaaagctcataaattcgcgaaattgcttttttacgtgtgcgaatcttctcaaaaggcacaattaccttattgtcaaaatgaaggataggctttacctttagaagactaccaatgaaggcttgggcgctgcttaatcgcccgccgcgctgaagatgagctaagtcatctaccataaaataagctcgaactgtttttttcatttcttccagttcttttataatatcttccggcgaggatgctccgtttttgattaattcagcagctttaagggcataaaagccttgagccaagcagctgatctctgagtcaaatggatacacatcaatattgtcgaccatcgaatcagccgctgctgcactgctgaatgttccgctgatcccgctggaaagatggatactgataaccgcatcataagacttgccaagctcttcatacaacgcaaccagctcgccgattggcggctgagaagtcgtcgggagctcattatgttttttcacttcttcgtaaaagcttttccagtccaactcaatttcttcacggtaagtctcctccccaaaaacaacctggagagggatcatatgtatctgatgttgttcacgcatttctttcggaatatatgccgtgctgtctgttacgactgcaatattcatagcttcgatacctgccttattgctttataactttattgtaagggaaacggcagcctaaaaaaagacctgcctagaaaaaggcaagtctcctattatactatctcatttctacccagccatttttaatggcgaccacaacggcttgcgtccggtcgtttacattcattttttgtaaaatattgctgacatggtttttaacggttttctcactgataaacaatgattcaccaataccgcggttgctttttccgtctgcaagcatctgcagcacttcacattcccgcctagttaaaatatgtaatggtctgcggatttcagggtaaacctcatgttgagggtgtgcagaaactccgcttgttgcaaggcggcggaattcgttaacgaggttgtgagtaaccttcggatgaaggtaagatccgccctcagccactactttaaccgcttcaattaatgtatcagcatccatctctttcagcagataacctcttgcacctgttttcagggcatgtgttacataattttcgtcatcgtgaattgatagaataattactttagattcaggatacagctctacaagctgttttgtagcttccacaccatttacgtttggcatattgatatccatgatcacaacatcaggatgatagtgctcaacaatacgagccgcttcgtctccgtcatcaccttcggctaccacttcaaaggtaggttcaaaatccaatatccgtttaacaccttcacgaaataactgatggtcgtcgataataacaatgtttactttagtcacaagccacgcctccttgtattattgttctatatactctagcattcggtcaatatgccttttggctctattttacaaatcatagtcaaagagataacggaaccttaatcataataaatgtcccaagacctattttcgaatctattgtcatcgttccttccaataaatctactctttctttcatgcccagcaagccgaatgatttgtttttcttctctttcgcttccttcaggtcgaaccctttaccgttatcttttatcattaaaatcacaaaatcctttgtgatctcaactttgactgtaatttcttcagattcagaatgctttagcgcattagacacagcttcctgtgcgagcctgaagagcgcaacctcaaactgaggcgctagcctctgatcctctgtttctccaatgcactgaaaatgtattttgaccttcccgttatattcctcggttgtatatagatattttcttaaagttggaatcaggcctaggtcatcaagggccatcggtcttaaatcatatataatccttctcacttcgtaaagggcattccgaacattttggcgtagatttttaatttcttggaacccgtcctctgcgccccggtcacggaaaatccgctcgattaattccgatctcatcataacattcgccagcatttgagcgggtccgtcatggatttctcttgagactctttttcgctcttcttcctgcgcctcaataattcttaagccgaaatcctgttttgcctgagcatcagcaagaagcagtccaacttcgcgcaaatcctgattcaagtagttgagcacaactgtaatttggcttactaatgattctgaccgctcaatgatttcctgaagccctagcaatctgcgctccaaatcgtcccgccgttcgcgcaattgcttctcacgctgctggatcatcgtcaattctacctgcagcttatgggctttttcataagcattgcggatttcctcttcactgaatctatgaaaattacggctgacctcggataaacggtttctcgcatggcgggtttgcacttcaagtttatcgccaagctcgatcacttcatacacctgctgtttaatttgtttcagttcttcgaccagctgttcatactgctggcgtgactgctccccaatttgaaaaacctcgtccttgctcccgtcaacggttttcagcatcttcatcaaaatagaatccagcactttggaatccatctttgttttattcataatttccctccgtcacggcgttgtcatatatttttattataaatgtaattgatctgcaaattatgtcgaattataatgaaagaatgcgtatattctagaaaaaaacatttttatatactatctactctttatgataccaaaatacgcacaaaaattctaaagactgtacgaatttgtataggcagtcttttatgcttagcaggagggtcagctagcatgctgcacagctattttactgtgaaagaagcaggagaacacgagattgttatagaaaaatcgcgttttatctgtcatttaagccgtgtttctaccgaacaagaggcacaggaatttatacagaaaataaagaaacagcactggaatgcgactcataattgctcggcttatgttattggcgagaatgatcatatccaaaaagccaatgatgacggagaaccaagcggtacagcgggagtaccgatgctcgaggttttaaaaaaacgcagactgaaggatacttgcgccgtcgttacacgctacttcggaggcattaagcttggggctggcggactaattcgcgcttatgggaaatcagtgtctgaaggattaaatcatataggtgttgtagaacggaagcttatgcgaatcatgcatacttctgcagattacacatggcttggcaagattgaaaatgaattaagggagtcacaatttctgttaaaggaaatccattattcagaaaatgttgaattcgaaacttacgtcgaagaaaaagaaacaaacgctttttctgaatggatgacagaactgacaaatggaaagagtgatattaaagagggagagttgacgtatcttgaaaaagccgtcaatcacataaaggagactgaataatggctgaacgcgttagagtgcgtgtgcgaaaaaagaaaaagagcaaacgcaggaaaattataaaaagaataatgttattgttcgtcctcgcattattagtagttgtggggcttggcggatataaactttataaaaccataaacgctgcggatgaatcgtacgatgccctatcccgcgggaataaatcaaatcttcgcaacgaagttgtagacatgaagaaaaaaccgttttctattttatttatgggaatagaggattacgcgactaaaggacaaaaagggagatcagactctcttattgttgttaccctggatcccaaaaataaaaccatgaaaatgctgagcattccgcgtgacacacgtgtgcaattagctggtgacacaacgggaagcaagacgaagatcaatgccgcttacagtaaaggcggtaaagatgagacagttgaaactgttgaaaacttcttgcaaatcccgattgataaatatgtcacagttgattttgacggatttaaagatgtgattaatgaagtcggcggtattgatgtagacgtgcctttcgatttcgatgaaaaaagtgacgtagacgaaagcaaacggatttacttcaaaaaaggcgagatgcatttgaacggcgaagaagccttggcatatgcccggatgagaaaacaggataaacgcggagactttggccgtaatgacagacaaaaacaaatcttaaacgcgctgattgaccgcatgtcaagtgcaagcaacattgctaaaattgataaaatcgcagaaaaagccagcgaaaacgttgaaaccaatattcgcattactgaaggtttagcgcttcagcagatttacagcggctttaccagcaaaaaaatcgacacattgagcattacaggttctgatttgtatttagggcctaacaacacatattactttgaacctgatgctacaaatctcgagaaagtcagaaaaacgcttcaagagcatttagattatactcctgatacaagcactggcacttccggtaccggaagtgcaacagacgggactgacagctcaagcagttctggcagttctggcagcactggcacaacaactgacgggacgacgagcggaagcagctattcgaatgacagcagcacaagctcaaacaacagtacaacgaattcaacaactgattcatcctattaaaaaatgcccggtccttttaaaggatcgggcatttttgcgcagaaaaaaactccggaacataagccggagtttttaattccttttcaccagccgtttataaaactttgtaaacggcttaaatttttcattcacgagtcctgtcacttctgctatgatttgcataaaaataattaaaatgaagataataaacaaagaaagccaaattgtggcacttttaagtacaatcgcactgatactgaaaataaatccaattaaataaataactaagaccgacatccgatgtgaaaggccaaaggccatcagtctatggtgaatatgcgacttatcaggcgctgaaatcggctgtttgtttaatattctcctgatgatagcaaatgttgtatcaaaaatcggtacgcctaatataataatcgggataacgatactgaacaatgtgacacttttatacaggcctaataatgaaagaatcgagatactataccctaaaaacagtgatcccgtatctcccataaagatttttgccggatggaagttgtaaaacaaaaaccccagcgtgctggcaataacgactaatgagagtgacagaatgagcacttttccgccggatagcgccatgacagcaatcgttgacaggccgataacagaaagaccggcagcaaggccatccaatccatcaatcaggttaattgcgttcgtgatgccgacaatccataataccgtcagcggataagccatccatcctaactcaaatcgttctgttaaaaaaggtactgagaaaaagtccatttttaagccggtgcttacaatcataatggctacacctaattgaatcaaaaacttaacttttgcacttaattgatatttatcgtcaagaatacctaacacaataatgatgaatgctccgactgtaattgccgtcatccttgtttctgtgtaaataccggatgcaagcacgcctgcaaccaccccgataaatatggccagcccgcccatgcggggcatgattttgtcatgtacttttcgattgctgggctggtcaactgcacctattttaatcgcaatcctttttacgattggggttatgattaaaactgtcagcagcgagacaataaacgcaacaacaatgcgaatcatgcgttcgtcaagcataaagaagtctcctttggaattaaatgaagtctttatttatatagagaaccgttccttccattataccttctccttagttattataacaagcttcatcaaaaagaaacacgtataatcaaaaaacgcgcatcccaatttataggactacgcatgtttttgaatccctgtatatttcataatttgtctaaataagcaattccaatcttgtgtgcgagcgatgtttcggcgcatttctttataggtttcgtctccgttttgttcgagaactttttcacaagctgctataaaatcaattggatgatcaccttctacatattcgtatacatacggcttttgcatttttgaggttgacggaagattagagccgacgacaggttttcctgccgctaaaaattcaaatagtttcagcggaaacacagcttgattatacgatgattttttatatggcatgatgccaatgtcgataagctccataaaatgcggaacttctttcggatctgccggaccggtccatataacatttggaagtctcagcagctcttgaaatgaaacgtcaccattggtggcatccgggccaacccataaaaatgtccaatcaggcttttgcagggcggcttcttcaatcattttaaaatcgagcttcggtttaattccgccgataaaacctaacactgttccttctctcccctgcagtatactgcgatcgggagcttgtttatttgcagaaaacatctcatactccacaccgttttccacagtatgaaccttttctcgtcctgcagtcagttttttgtctacttccttgtgaagataatctgatgaacaggttattgaatctgctcgttgtataattctcagctctgccgttttaatgacttttcgccggaattcagacagcagatttgatcggccgctgatcggcgccgcccataggtcactgcagtcataaatgacctgatcccaaggatacagcgaagacagcagcgggaatccgggaaacgtgtaccataaacagcagcgttcaccgtttgcagaagcaggtgtaagctcatcgagtaatggggagagcttatgtctgtaaaagacatctgtatatcgtccgaaacgaaacatttttttctgcagcaggtctttgacagcgaattgcctgatgccagaatggacttcctgaaactctttcccttgggcacgcggagccggacatacccaaataacttccttcgtttcctcctgagcagctaaaaattctgccagccggtgccttctgtatctcaattggtcttttccccattcagcagtggcaacgatgacatgaatgattgcttcttttgtttccaccttcatcaccttttctctctgtttgcggctataatctttttttcaccgcgttttttgcatattgaacaaaacaccatgttgctttcataaaatgaagccgttcgatctccctgtagacaaaccacgtttttttcgcagccttccatttgttgctggaaattgagttattgacaagccgatattcagccaggcattcattcattccataggcagtaaatcctttttttaaaagagacagccatgtggctaagtcctgtctcgttctgatattcggcatttggatctgtcccgtttgctccctgtcaatcatcaccgtcaagcagccgataattgtatttttcagggcgtcatcgtacgtcaggctttccggcgcatgaataaatttatcgagtggggtcccgtcctgcgccattaagctgtagcccgtgaaagaaaacgcacaggagcgctccatcataaactcaagctgcttttccagtttgtcttttttccatttgtcatcactgtccaaaaatgctacgtagcgcccttgagcgcgttccaacgctttgttgcgagcaaccgcagctccggagttctcttccagatacaccacatgaattctttcgtctattttttcatactgctgtaaaatgtcgcgggtcccatccgttgagcaatcatccacgataatcatttcccaatgaggatggctctgatctaataccgaatgaaccgtgtcttcaatatagtcacgcgcattataggaaggtgtaatgacagatacgagaggtttccaattggtcatgatcacatctccatcgtatgattttaaaaggattccctgaaaaattcaggaatgacaacgaacataaaggcaatcgtaaggccaatcataacgccgagaactgctttctttttcggagacattccgccgcctgctgtctcacttacggtttcggaatcagtaacacttgccgctttcaggttaagctgtgtgtttttgagctcatacaaaaatctctctttatccactttggaatcctcgctcaccgactcgccttcaagcgcgtctatgctgctgcggatgacggcttctctttctgcatacagcttttgatcgtttttgaggaaggtggaggaaatggcttttaagacagattccgttttatccttatcctcgtcgctatagcttaaagtcagtaacgatttggattccgttttgatggtaagcttctctttgatctctgctacatcttcatccttttcatcaggaagcgcctccttcaaaaaagagtcgctctttaatagaagcggaatctcttctgtgctgttataaaccggatgatcatagctccccacagccaaagtatcttcagctgtatagctcttttgatcagcgatctgtgacggcaggatataccccgccgcacctaatataattggcaccgctatgatccaaatgatatttttttttatgcgacgggctattcttatcaatatatcgttcatataagtctccctgctttttgtagtctgtttatctgtacatcggctcaggcatttgtctggatcgccttaacacattcacggctgcgatgacgagcgccataaacacccaatggaaaaataaatttgaaacagagcttgggctgatacttgataccaggaaactgaccatagcggtaataagtccttctgtgatcagttttgactgattttctaattttctttcataaaacttgtaaagcacccatatgaggtaggcataaatggacaggtatcccagcatgatgaacaagccaaaattagccagaatttcaacaagccagttatgcacctctgccacattgtcagtatcatatacagcataatgctcaagataataggatacatttcctgctccgactccgaatccgtatgaatcaaggaaaaaatgccaagcgtttttcagcagatttgcccgagccacatttgatggaagcctgtcatgaaatgaatgcagcgtctgcggggccagaaacagctcccaaaactttgaatagattttgctggcgaaaagaactgcgaaaagagcaattcccgccgccgacagccatatagccattttctttaaaacaggcggcaatacaatgaagatgtagacagcaatacctgcaaaaatacccagaaggctggctcttgaaccagtggcaaaaattaaatacaacgcacagagcgagagcacaaggccaattgccctgatgtatccattcttaatgtttttcatcatcgtgatgtaaaaaaagaagctgatggataaaaaggtcgcaaagtcattttgattaaaaaagaccgatgtcggataatgctgcttatactccggtccgctgtacaatgtggaactcgcaagatgatggtgggtgatatgattgtaaaaaccaatgatcatcagaaataccgtcatcaccagccaaatggcataaacaatcatcagccgctccattttttgcacgtacatgacaataagataaatgaagaaaattcccattgccaataaggctaaatatttgaggccggctgttaccgacttggcccacagcaaagaaacaaggccatatataaaccaaaaggcgaaaaagagcaatatcccttttacttgcagcccatgccatctttcaatatgggttcgattccgaaccatgccgaaaatatgaaggcaacccgctgcaatgagcagaagccggtaaaggaacaaactgaaaaatccaagatgaatggcgaaaaatgcattatttaaaaaagtgcaggcgatcaaaatatagattacagccataaagaaccgttcttttgttgtaaatgcggttgcaagcgtcagtaaaaacaggccaattgccaacaccgcaagcgcagcagccatctgcatgaaacctatatctttatggatggctcccagcaataggacgactccaaatatagcagcggccagtaacgctagcgtatggaccgctgatcgtttgatactcacatgtttaacccctttcctgatgtttcaggagccggcggccgagcctagcagccggcagcttcaaccaagtaacactttttctttttataaattgacgcttcccaagtctttagccaattcttcaagcggcaagcccggaaaatacttgtcagagggttccgttccccgaacagcgggacggccgatagagtgataaatgtatccggctgcctgcatctcttcaagtgaaaataaatttctgccgtcgatgatgactggctgttttaagaggttttttacttttacaagctccatttctttcacttccggccaatccgttaaaatcaggcatgcctcagtgtcttcaatcgcagcatacacatctgtgtaatactcgacctgttcgccaaggatcgctgaagcttcaggaatagcaatcggatcgtatgcttttacatgggcgcccagctgctgcagcattgggataatatcaagcgctggagcggatctcacatcgttcgtattcggtttgaaggctaatcccaggactgaaatggttctccctttgacgcttcccataacagtcaaaagtttatctacaatatgaacacgctgcttttcgtttgtttcaatgacagcttcgatgagcttgaatggatagcctgccgattttgcgatttgaagcaacgcggttgtatcctttggaaaacatgaaccgccgaatccaatacccgctttaaggaactttctgccgatacggctgtcaagaccaacaccatcagcaacttttgaaacgtctgcgccgactcgctcacaaatgtttgcaatatcgttgataaaggaaatctttgtcgccagaaatgcattcgcggcgtacttaatcatttctgcactttctaggtttgttttaatgacaggagcatggaatggctgatgaagttcctcaatgatggcagcggctttatgacttgttgaaccaatcacggcacgctccatattcatcgtgtcatgaatcgctgacccttcccgaaggaattcagggttagatacaacatcaaatgagtatctcccctttgaggctttttgaacgatagattgcaccagtttccctgttccaaccgggactgtgcttttatttacgatcactttgtagccgttaagatgctcaccgattgttttcgccgccgctttgacgtacgttaaatcagcttcacctgttttggacataggcgttccgactgcaatataaataatatctgaggcccgaatggcggacgggatatcgttcgtaaaggtcaggcgctgatccagcacatttttttcaactaagtctgcaagccctggttcatagattgggattaccccatttttcagacttctgatttttgattcatcgatatcacagcaaacaactttattgccgatctccgcaaagcaagtgcctgatacgagtcctacataacctgttccaatgacagctatttttttcacagcgctcatccctctcctgtaaaatgatcttcctatttatattggtcgcagtttcttacgattaaacggacgttttcgtgaccgtctgatactgatgatgcaaggccttggcgttttttcctgcgtcaaattgagcctgcacggtttcatataagtcatctgctacttccggcttccatatttgctcatgttcgtaccgagtgatcgcttccgccaaggcttgagcggatttcggtttaatcagcagatgttggtgctttccgaacaaagacgacactccgccaacatccgtacaaataacaggaacccttagcgccagcgcctcaatcacaacagtcggcatcccctcactgtaagaaggaagcacgaatagatctgccgcaagtaaatagtctcttacctgatgattcgggacttggcctgtgacgatatgccccttctgcgtcagcgtcgattttgcgggaccatccccgacaaagactgccttaggagagtcctgcagcgattcgatcgcttcagacagttcaaaaatgcctttctctctgaccagccggccgacatagacagccagacgctgatcgagcgggagtccgagtctttttctgatttcctctttcgtctcctcattctcctgaaaacggctgagctgtatgccgattggcaaaaccgagctgtcaaagcccgaaagctttttggcttcttcctgaagcttgtggctgactgctaaaacaactgatgcagaacctacggcacgcttaaaagctttaaacgctcctttgctgtaatgcggatagacattcacatcactgccatgcaaggtcaggacataaggaatttgcgctgactctgacacgactgccgcagccccgcccgatggcatggcaaaatgagcatggatcagatccggatataggccgcgctgtttcatggtttttaaaacggctgatgcgattctccgatgaggctgcgcccacttcagctggccgggaactgcccgatagaaaggccggtaaaccggtattccctttctaatctcatactccggtctggcatccttttttcgatatgtctttttcagcatgcggacaggcgctgaatgaaaaggccgtgggcatatcacagtgatatcaagcccgagtttttgcagctcttgcacttgtgtctcatgaaacacaccctcaccgggtttcatactgctcggatatacgcttgtgatccacaaaatcttcatgacaaacgtccttttcttagtagtttgcttttcgtttgagggtacgcttttaccaaaagaaagagatagcacagcgccccggccgcaactgaaatggccagccgcatttctgcctgcatactgaagtgttcggtactgaggcttacaccaaacgcgatgatgcccatcgccgcagtaatcagaaatggcttcataatcgactggaaataagctgaaaggttaagcttgatgacatatgccaaaagccagcgcccgatcagaaaattaacaacgctgataatggcatacacccatgcgactgtcagcaggcttcccgtctgtacagctgcaaacagtgataatccgtacagcagcagcacgccggaatcccaataaaacgctaagtcagctcttcctttagccagcaacacagatccatttggattcatgagcactcttagtattccgacaatcgccagaacatttaggatcggaacagcagcaagccacttttctccgaaaaccgctgtgataaaagcgtctgacacagacacgagcccgattaacagcggaaacgaaacaagcgccagcatttttgtcatattcagaaagccttctctgatcacgctgttttcatatttgttttttgcgaaaacagggaatgccacccgtgtgacaatcggattgatcttcaaaaccggaatggtgacaatctgataagcgaggttataaatccccaatgcttcagcaccaataaaccggccgatcaaaatcatgtcgatatttgctcccagcctgttcacaagacgggatgaaagctgaaaggctccaaaagaaaagaaatccttcatgcctctcaaatcaaaaacaaaagcaggatgccacttttttcggtatacagcccaatataaaatccctttactggactgcagcaggacttgagaaatcacgtacgccaaaatcgcatccatcataaaaaccgctatcgctaaatatccgaatgacaatacatttgaaaaaatctctattttgcttaacgtattaaaatgcagctgcttttgcagcatatactgatattgctgtccaattggcgcgatcaaaaacataatcgccagaatccgaaccagaaacaccagctcttctctttgataaaatcccgcaatgacaggactgctcacatataaaagaacaaacagcaaaacgcccgtcataatgttaagccaatacaatgttgacagctggcgctccgtcgcgtcgtctctctgaattaatgctgcgccaaaacccatatcgagcacaatctgggcgaaaactgtaaccgttgtgatcatgccgacaagcccaaattctgttaaggtcatcatatttccaagcagggcaaactgaacaatttgtatgattgtaatacacatggttgaaatacttgtccactttgcaccgctcatgatttgttttgtaatacttggcatcatattccctacttctttttaagctcagattgatggtgaataatggcattccgttttatcttgcaccatcacccgtccaaactactttacaagtttttaacataatttttaattctaaagtgaaagtcagattgcgaatgtaatataaatcaaatatcagcttttccttcggcgtcatatcgtaaccgccgttcacttgagcccagccgctcaatcccggtttaacagccagacgctgtgtaaagcctggaatctcattctggaatttttccgtaaatacgggccgttccggacgagggccaatcatactcatatcgcctttcagcacattaaacagctgaggaagctcgtcaattctcgttcttctgataaaagctccgatccttgtcacccgcggatcttgcttctgtgcccaaaccgccccagacttctcggcatctattttcatggaacgaagcttataaagcttaaatggtttcccgcctttccctacgcgttcctgcgtataaatggcaggccccggcgtctccaaacaaatcaatattgaaaataccgcaatcattggcagcgcaatcgccaacccaatgagcgcaaaccaaatatccattacgcgctttattgccaaataacgagccgtcttttcagataatgtaaaagaatgtatttgctgaactgagaattcacgactcacattcatgcttttctctgcactcactgacacacacctcacgatttgtttgggatgttatgatgacctatgccagtcagtttagcagacggatgttaattggatgtaaatggtatgttaagaagtgtgaatttgttattttttctgacatttatccgtaaactttttattgttttagacactttttttaaaaattaagcatattgtttaaaaaaagagacaaatcattttactgatttgtctcttttcgttgtgaagcatttaatattgaaaataaaactttgatttagaggttaacagcttgtattgaacctcaaccattttactaaagaataacatggattttcgttccacattccttgtgtccaagacaattgcttggttatccacttttgcactgattttattttgagaagtgtttatcgcaaattcaattaatcgctctttctttacatgagcaagctgttcaagcaaactctgcacgtttaccgtcaattttgtgcaattaggctctaactctatacgttttaccggtaatgagatttcagactgtccggtattcacaatcatttttgaatgatttggcaaacagatttgcttatctttaaaaataaatgataaatcttttgattcagtttcatatgaaagttctgcttctgtataggcatgtttctttatatcaatcgaaagattatcgtagttcattgtgaaatatggtcttgcactgaagacaaacaacgcattatgccctaaatacatcgtgtttgttgaatacttatacgcagcacgcttgtttccgattctcgcccttaatttataaccatctattgatgattcaataaagaaatcccaaacgcctaaatcttcttctgcagatgccagttcatcaaacttgcactcaaatgtaaatgttgaattttcatacttagccggcgcgatatatttttccgcctttgtatcgcgatgaacaaatattcctgtcagagattgattttgattcgtttcatcatccaacaatttgtgtttaatggttccttgaatgctgaggctgtgatcgctaaattcaatattctgcagataatgttcaagcttatttttataatttacttttaataactcttcagaaattggatagcgttctaagctcggataacgtgcaattaaatccccattatttacaacacagaactttttaatgtcttgttcttcacgctcatactgggttaacccctgcaaatcattattccgaataaacagcagccgcaatttgatatgcggaagcacaaattggtcagcctcttcaggtactgcatgaataaatgaggacaaatatttaaaccattcagctctttcttcatctgtcttcatttttattgtgacattttttgtccgcgaaaaatcgaaatgcctgtttaaaaatactgccatcagtttcgtttttcttgcttcttccagatcactagccttgatagcagagataatatcttccattgctccataaaagttctctgggggaacataagcaacactcatatgttcaccgtctcttttgaccagatagtaataatcatagtcagctgaaacagaaatcttctttgcttttaaataagcgttcattgtgaagacttgatcttccgctgcttttatgtgagtagggaagatgatttgattttcttttaaaagtgaggctttaaacagtttttggggtcccaatgtgaaaacaattttggaatcaaccaaatcaacatctgggtttgtttccttaaacattgatttgggaacacctcggccgtttatcccttttaacttacctaaagtaatatctgaatcattctcttttgagaaattgtaccatcttaacaatgcttcattgcctagatagtcatcggaatcaacaaacaggatgtattcacctttggcaatttttattgcatcattccgcggcgcacctggaccgcctgaatttacgattctttcaacaacaacaatattgtcatatttctttttatatcgattcaaaatgtctaaagatgaatccgtagatttatcatcgacacatataatctcataatcctcttttggcatcgtttggttaactaagctatcaagacattcggaaataagatcttctgaattatatacagggataacaatgcttattttcatcgattacctcactaccctaatggatcggttatatttttgcctgataattatatcaaaaacatctgtcaataagaataggcctaaccttaaattttgttaaacttttacatagcatatgtggtttaaaatttttctcattttatcgtataaaaaagcttgccggcaattcctgatgggttctgccggcaagccgctattgatgtctactaatttaatcccctaataatatccaatgattccttcatatattgcttgagctgctttttcttgatacaaagcactctttaacttacttgcgtcgttcgcatttgaaatgaacgccagctccgctaaactgctcggcatcgttgattctctgatgacatggaaattcccgattttcacgccgcggttttgagtattgagtgctttatagagtctgttttgtatttctgtcgcaagccgtttgctgttttctgactcatattttgtataatagtaggtttcagtaccggttgctgctgggctcgctgaattggcgtgaatactcacaaacaggtttgcattattgctttttgcttttgcaacccgctctgaaagctctaagaaaacatctgtagatctggccataatcggaatggctccaccattggaaagtttgctgtttacaagcttagcaacggcaaggttaacatctttctcttttaaaccattaccgaccgcgccgctgtcataaccaccgtgtcctgcatccacaaatacctttttgcctacaattacatttttaagttggttcacgacatttgttgtcactgaaatagttccccaagaactgtgaaggtattcttgctatttgatccgatgactgttcttgtcgcagtcggcaatgaaccggcgtcagtaaatagcattgggcgattttgcttcgccgccagcacagaacccgctaaagcatctgcatattgatagccattgctgacaaatgcagcttttgatgaagaataatactttttcgctatgttggcagccacttcaaaacggctgttcccgccgattcttgttggtgatggcaactggctgtaaacgctttttgagacactgatttctcccccgaccacaatagtcgatgttgttcctttgctgttcatcgcatttttcgttggttcgggaatagagcttgcagtcgtcagaagaattggaataccgttacgggcagcataagaaccgattgccagactgtcagcatatgccgttccatttgcgattactgcttttgaatttgaagacaattttttagaaatattttgagcaacttcatagcggcttcttccgccgatccgttccacattggaaatacccaattttttaatgtcgcttacaacgttgttagaaacactgatcgttccgccaatgacgatgaccttgctcggtttaagctggctgattctgtctttcgtcggtgcagtcagtttagatgattccgtcaataaaatcggggcattgtatttataagccaaaggagcagcagttaatacatcggcatacgctgttccgtttgccacaacaaccgtgcccgcactgctccagccttgttttgatacatttactgcaacctcatatctgcttgctccatccagccttgtaacagagtttgccgcaaacgcatttggtacaaataacacgactcctagtatcagcataggtatgcttttaagaaagatccgcaaagatagtccctccaaagattcataatgattcataaatcaaataacgaacaaaggaggcatctcgcctcctttgactctaacaatcttttaatagcttgatagagttgttcccggatagtaaaaacttaaaattgttgtataagattgtccggcagctgctctggcattggctccgtactgactcatgcctatgccgtgtccgtatcctttaccgctaatgagaaaggcgtttgtattgcttgagacagaagcatatgtactcttcatattggaagcgccaagcatcgttctcagctctgttgcaggtacagtaattgttgctgttttttcactgaggcttccatttgacaggatatagccatttgatttttctttcacgaaatatgagaatgtgacgcttgctgtttccggccgctgaccggcagttttctccgtgctgaatttcacactggatattttcgtgattttgatagactcggcattgctgtatttatttttaataaaccagcttttcaaaccgctcaaatatgatgagtttgtttcatttttagagctccaccatgaacccgggcttttcagattcagactgctcttatcaagctgggttttatttaaagacagagaccagctgatttgcgggtcgtacgtatcttttttggcgattaaataaggaagctggctgctccacacctcaccgctcgcttctgtgtagccgccgttgcttgaggaatacgtagcagaaatcaaattcccattgtatttcaaaacttttccttttgtagcttcgaccacttctgaagtttttgaattccagtcatatccgccatatacctgaaaagcggtggtgtcttgtacttcttttccggccgaactgatggaataagttctcgctgcgacagcttgggctttaagcgcttctttctgccaactggccggcatttcatgaggaacaacaccctttaaataatcttcaaaggggatattcacattgattggccgaacatatttgcctgactctattgtaaatttcatgtttccgagatatggcgttccgttcagactgatagaatttgtagttgcatattttttaggctgtgctgtaaaagacgttccaagcgtcttgattgcagtactgtttttataaagcactaggtttccgccggttaacttgactgtatatccagttcctgcaaaagtatctgccagtttgttctttaacgtatcactgatggaaatgcttcctccaagcagcgcaaatgactgagttccttttgacgctactacatcagcgactggtgacggcaggctgcctgattcaaccagcagtaaagggcttccctgctttgctgcaagcacagatcccgtcaatgcatccgcgaatgtttggccgtttgacataaatacctttgttgctttcatatttaattctttaacgatattggcagatacctcatatcgggaaacgccgccaatccgtttcacagttgccttcttttttaatgcagcttccacaccagtgctgacactcaacggaccgccgacaattgtaaccttgcttggaattttgtaatcactgcggatgttattgtctcccgcaagtaaaatcggataaccgttcattgcagcatatggcgcgattgacagggcatccgtaaagaccatgcctgtggccactactgcctggctgtaattccccatccgatcggctatgtttttagaaacctcgtaacgggttgctccgccaatccgatcgatagaaccatatttttttaatgtattttctacatttttagaaacactgattgtcccgccaatgatgagaatattgtcaggatttaattttgcaatttcgctttctgtttttggtgttagcgaatctgcgtctgttaataaaatcggtgcatcgtactttttggcaagcggggttgctgagagcgcatcggcaaaagcgtcccgattcacaatgaccacagtcgttggatttgtccatccggcagaggcgacattattggcaacatcaaaacgggttgctcctccatatcgctccgtatccgcaattcttgagccgggaatttcatatccgcctgtgatatcgacatccaaacttgatttgctgcctacataattactcagcttaaccgaaatggttttatcagcggctttcgcagtctgcataaacgccggacatgctacagccgccgcagtgactgacgatagaagcaagagcttcatttttttcaaaacatggaaccccctaagagttttttattactttgtctcaagatccttaagcattaaagcgccatttgaatcttttgtatatttgacaacaactttttgcccttctgaaatgctgttcattttgtcctgaaggtctgaaccaacctgaatcgacgtctctttatcatcaatagtgactgcaattgtatggctgtctgccaaaccggcaaaagtgccttccttcgttactgtctcttctgcagctgcatcctggctgtctgaatttgtttctgctcctgatgagttctgagctgtgccgcacgcagacaaaagaagcagcattgagaacattaaaatagcaatttttttcattcctatatcacctctccactttttatcgacaattttaagcttattttaagatttctttcaaaacaacgaaaaatttttgcggattttcttaaaataccgaaacatttgttacaaggagccgtctattgtaaagaatcagacaaattttagttgttttcaaatattaagaaacttataatcgtactagattacaaaaaagcgaggactttattatgagagctgaaaaaagaaagaaaaaaagaaaggcattacttgtcattttagccattgtggccgtatttgtactcggaactggcggctatgcatactacttatggcataaagcagcatcaaccgtggcaagtattcatgaaagcattgataaatcgaaaaagagggataaagaggtcagtatcaataaaaaagatcctttttccgtcttaatcatgggtgtggatgaacgcgacggcgataagggccgtgccgatacgctcatttatatgaccgttaacccaaaaacgaatacaaccgacatggtcagcattccgcgtgacacgtatacaaaaattatcggaaaaggcacaatggataaaatcaaccattcatacgctttcggcggcacgcagatgacggtagacactgttgagaacttcctcgatgttccggttgattattttgtgaaagtgaacatggaaagctttagagacgttgttgatacacttggcggcattacagttaacagcacattcgcgtttagttatgacggttattcgttcggcaaaggagaaatcacgctgaacggaaaagaagcgctcgcttatacccggatgagaaaagaagatccgagaggcgacttcggacgccaggatcgccagcgccaagtcatccaaggtattattaataaaggcgctaatatttcttccatcacgaaattcggagatatgtttaaagttgttgaagataatgtgaaaacgaacttgaccttcgataacatgtgggatatccagtccgattacaaaggtgcgcggaaacatattaaacagcacgaactaaaaggtacaggcacgaaaatcaatggaatttactactaccaagctgatgaaagcgccctttccgatattacaaaagagctgaaggaaagcctcgaaaagtaaaacaaaaaagaagcttcgcacaatgtgcaaagcttcttttttatttgcctgtaaatgaatccggttgttctttccgatacccgtaatgaaacagcaattcttccacaatccggcgagaagcctctccatctccatacggattagaagcctgggacattttcttgtactcatcatgatcagttaacagctgttttgccagctgataaatgttttcctcatccgtacctgcaagtttcagcgttcccgcttccactccttcaggccgttccgtcgtatcacgcagaacaagcactggtttcccgagagatggggcttcctcctgcacgccgcccgaatctgtcaatataaaatgcgatttcgctgcaaagttatggaaatcaatcacctctaaaggttcaatcagatgcactctgtcagaatcaccaaaatgcttctgagccgcttcccggacaactggattcaggtgcacagggtaaacgacttgtacatcttcaaattcccctacaattctgcggatggccttgaacatattttccattggctcgcccaaattttcccggcggtgagccgtcaagagaatcattttatcctcacccacctgctcgagaacaggatgtgagtaaccatccctaaccgttgtgttgagtgcgtcaatcgctgtattgcccgttacaaaaatagagtcggcctttttgttttcttttaataaattgtctttcgcctggcctgtcggagcaaaatgcaaatcagcaatcgcccctgtcatctgtcgattgagctcttccggaaacggggaatacttattccctgtacggagccccgcctccacatgaccgacagcaatttgatggtaaaaagcggctaggcttccggcaaacgtcgtcgttgtatcaccatggacaagcacaatatcgggtttgatatctttaaacaactcatccaattttacaagtgcgttagacgtaatctctgccagtgtctgccgctccttcataatgttcaaatcgaagtcaggcttgatatgaaacgcatctaacacctgatcgagcatctgtctgtgctgtgcagttaccgttacataggaatctatttcaggatattttttcaattcaagcacaagcggtgccatcttgatcgcttcaggcctggttccgaaaacggtcatcacttttagttttttcatatttgtcacctggtttctttgtttaacgggctgttagatagaatttcgattggtccgattgtataaatagatctactttcttctttattttaaagcaccatagctttttttcaatatttttactgcaaaagtacacactgacatcctttttcggaaccaatgtggttttataagaattaatggataaaacaatattggtgttttgtaaataagccggagcaaacttttgctgaacgagattccgatcaacctgtatcactgtcccatcagctgaactgatttgattttttattggtattaaaaactcttggttattgcattcgagcaataataaagattgcttcggaaaaaacaattggcttccaggaaatacgaacgttaaatgctggtccgaatcattatctctgaattcgactttcagaacttcctgctttctgatatccaccgacaaattatcataggttttagtaaagtacggccgtgcgctgaaagcatattccccgttattcccaatatatttagcatgttttgaataaggatacggttctctgctgctgccaattcggacgcgttttttatagccgtctatccccgattcaataaagaaatcccacacaccaatatcttcttcatgaatagccaaatcagtaaacttcgtgagaaattcaaattctccgtccttggaatacactggagaaatgattttttcagtttttctatcacggtgcacccaaatgccgtataaagtttgcatagcttgatgctctggttgtaaagccgtgtgggtaaccgaccctcttaatgtgaaagtgttgtccttcatttgaaattcgctcacgtaatgactgattttgtttctgtcatcaacaatccgttcattctctgccaaatgatatgagataaggctgggatagtttgctatgatatgaccatttttaactgacgtatattgggccatattttctttatcagcttcaaactgcttcaagccctttaggtcattatggcgtacaaagtgtaattttaaccgcgtatgagaatgaacaagcttatcaatttcccgtggtatattttgttcaacaaaatgatgcagctctgtcatccatgtttgctgctcccgttcgtcctcgattgttacggtaaagtccgttgttctggaaaaatcaaaatgacgatttaaaaacttcgccataaacttcattttgcgattatgtgaaagacggctattacgaatcatatctatgattaccttcattgcgccatagtagctttgaggcgcaacgtatgcaaacgtcatatgctcgccgtcatgctgtacagcatagtaataatcataatcggccaagacagaaattttgtccgcttctaaataagcctgcatgacaaatacctgatcctccgtagcctgtatattagaggggaaatatatgtcatgcattctaagcagtgaaactttaaaaagttttgtcggtcctattgagtaaacaagcggagattttacaagatccgcctcaggtttcgtttccttaaaaatagcttgcgggaccgatctgccgtttacaccgaccattttcccaagcacaatatctgaatcatgctgttttgcaaattgatacattctctcaaacgcttcgattcctacataatcatcggaatcaataaaaaaaatgtattcaccgttcgcagcacgtatcgcctggtttcgcggctctcccggccctcccgagtttttttctcgttctataaccgttatattagaatactgttcactgtacttttttaatattgaaaccgtgccatcctgagaacaatcatctacacaaataatttcgtactcattattcggcatggtttgttgaaccagactatccaggcagcgggagataaaatgttctgagttgtatgtgggtactgctgcagtaattttcaccatgacacctctatccttatccgcttctatttcattcacaaaagctcatataatgaacaaaaacagtataaaaaagcactatttcgtcatttcaaatacttcttcccatctttcaaataatcgggcttcactatattcagtatccattaagttctttgcgttttttccgtattgaatggctctctcagggttgtcgtacaaataaatgatactttcagcaagcatgtcaatattatcaggttctacaagcattcccgtttcgtgttcttttatgagctccctcgggctgtatttcacatcaaaactgacaacaggggttgcgcacgaaaacgattcacaaatcgcgagactaaaccctcaaattttgatgttaataatgtggcaagcgcctgctgataaaatggagcaggatttgcgacatacccttttaaatgtacattatctaacttaagatcatcgatcaattgctggtattccttatggccaggaccgctgccatatatattcaggacaatatccggccgggatttttttacgattcccattgcttttatgaccttatcgatccctttttcctcatgatatctggccaccatgacaaactcgtttttctttttttcatacgtttgtaatttttcaagccttcttggtgcatgaggaataacaaaaatattattgttcgactcaaaatccttcatgatatcttctttttgttcattcgttaatacgatcagcccgtcataatccttaatatgctccatcgcatattgatgattgtttcgaactttgctgcctaacgtataaggataatctaaatgatttgagtgaacacagtaaaatcgttttgccaatcctgcacgcatttcatttacttttgaagcacttccgactccatcacagatgataatagggtccttttctttctcacataacgtttcaagccaatgtgtatgaaactggtgcttgtttttgaaaaatacagcttccttttcatcacggccaaacagcataactccttgactggctcctgttttaaaatggtaccattctgttaaataacagaaaccgtcgggtgctgtgtagtgaatttgattgatttttccgcttcttgtatcgaatatcacagttttatttacataaccgccatgaaagaattctcgctttgtcatttgcatattttcattgaaatgatctacatataaaagattatccgactcatcccattttttttttttatatataagccattcttgaagtattccgtttctaatttttcctcattatgatgcgcagcatatggttcttcaaagcgattacaattttgatcatagtaactttgttgcgcttccccaatttttatatgcttatgctgatttttatagtcatcataaatattgaggatatttacatcagcatgcagccttccagcgctcttcagcacttgctcaatctgatcataattgtctttataatcaagtgtaaccaaatcgattttatggccgcgctccgcaaatgtaaaagatcttgacatcatagagcttgtaatgccgcctttttcaatgtctatttcatatattagtgaaaagatccttctcatcttcaagctccttcttctggtaaaaccttgtctgctattttttcacaaacagccgtttcattaattttctccgaaatccctcggcagtctgaacacgcaaataattattttctttttctaaagtaacttgccagcctgaaatactttgttctgataatggaatttcctttgaaccggttattcgcacacctgatgcaaagaagctattatcccactcggaacagagatgcaattcaatggtagacaactgatctaatacagagtgaacacgaagtgtaccgcttacggtaaatattagttcttcctcgctgtttacttttgcgttaaacgtgctttcagtgccgctctttttattttttaacttccaatacattttatggcggccaatagcatggggaggaatgcagcctttaaattcaaccttggctgacaaatataaatcggattttgattgccattctgccattaacagctcaacattcatatccttcaattgattattaaatggcacctgatctattagtttgtccacaaaacgcttgcgggtaaacggctcttcagaaacgtaataaatatttgtgcgaggccccgtatttttaattatgtcatgatatctcttcaaggaaggaaccacgaaagcatcaaggtggcctatttccttttcagggttttccaacatctcattcgtctctataaaacctagatacatggaagaatattcaactgaaagagattttaatgtagtatataactcaacttcagaagtcataaataaataatccgcttcctttatcaagcggctcagaaaataacgggaaagttcattttctgaatacaatacactgactatattctctttttcgtcaaaaatgacaattttttcagttgttccatcattcttataccattttgtcatataacaagtgccatctgcccttaaataaagatgctgcttcggtttgttagtgtccagatccatgtacattaagctatgtacatatccagacaaatcatattcttcccttttaaatctttgcctgctttcattaaagtaatcaatgacagcaagttctcctgatgctgtaaacctttgatatttgatataacgtccattattgtaataacgataaattggcttatttggttcttgaatatatgttaaaccttcttgttcaatcggatgcttgattttatctttctgaggttcagaacctttaaagtagctgtacatattaataacagcagtatctttaaaagaagagggcccattgggctcatgatgtaaagtgacaatttccattggataattccaatcgatcgtattgatactaaacttttttgcagcattcagctcttgacaaacaaatgctaattttggagtagaaaccttaatcgtcatcatctatttattacctttcgaataaattcgtacagtcacattttcagaactacattatatcacttttgctgagcaggctctagagatgaaaaagctgttatgtttcttgaaataccggatcagttgaaactgttttatctatcaattaatgatatttttttgtatttcctcgaccccaaagtcactgaattgactcttgtttaatattggtttttcttatatgattaaatgtgtttaacagaatgaaaatagggtattgatgagaaaagaaactcaaacattttaaatactcagcattcaaaagagtgaccctaaatctgttcttaaggaaggtgctttgaaattgaaaaaagtacgtaaagccataatccctgccgcaggtctcggaacgagattcttgccggctacgaaagcaatgccgaaagaaatgcttcctatcgttgacaaacctaccattcaatacataattgaagaagctgttgaagccggtattgaagatattattatcgtaacaggaaaaagcaagcgtgcgattgaggatcattttgattactctcctgagctagaaagaaacctagaagaaaaaggaaaaactgagctgcttgaaaaagtgaaaaaggcttctaacctggctgacattcactatatccgccaaaaagaacctaaaggtctcggacatgctgtctggtgcgcgcgcaactttatcggcgatgagccgtttgcggtactgcttggagacgatattgttcaggctgaaactcccgggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcacgcctgagattttcatgtatttagaggagcagcaggttggcgccggcggagaaattcagcttacagacgccattcaaaaactgaatgaaattcaaagagtgtttgcttacgattttgaaggcaagcgttatgatgttggtgaaaagctcggcttcatcacaacaactctagaatttgcgatgcaggataaagaacttcgcgatcagctcgttccatttatggaaggtttactaaacaaagaagaaatctaaacaaaaaggctattggacattcatccaatagcctttttttatttcaacatcaaagtcagcgtatgctcttcattatcaactgcgaagacctgatcagctgtatttacaagaaaacgcttcttgctgctgtcatacaatacatcgctatcactcaaggatagtgacgccgggttgataggagaaatgttatgaaaaataagctctgttgctttatcattctccagcacatagctgattttttcataatcaaaatctaacgtttttctgccgtcagctgtatccccttcagtatatccattcaacttggattgaatgctggtgctgctgtctcccaggaatttcagaaagtattcataggaagatgctgcgttttgcgagacataagacgtaaatgcagcggcttgcaattcagcgtgtttcatgttagttgcaacagcgctctgtttcacataataagagtgtccgtcaaactttattttcgctgcttgtttgccttttgcagctaccgtcacttttgtaccgaatggcagtgtaacgtcagccttctgtttcaaaccctgatccttataagcagccgctttttcatttgctataaacccttgcttattgactgcggttaagcgttcctctgacttgccctttgcattgccatgatgattcttcacttcattttgcggaatagcgccaaacgaagcaattgtacgaagcggagcattaaagaacatcgttcctgccatgaatacagtcaggatagacaaaatagcaatttgaaccgcattagccaatgatttcggctttttcttcttttggcggaaacgggcaaacgcttcaggatcttctttcttcctctcttccgtctgctcttttttatatgtctctttttcttttttagacagcttattaaaccagtcaataaacgctttatactctttgacaactgtttttgtttcatcaaacatacgaagctcgccatagtgcatccaagcaacacggtcacacatcttttcaatctggccgatcgagtggctgacaaagaaaatcgtttttccttgctttttaaactcatttattctgtctacacacttctgataaaacgtttggtcccctacagaaagcgcttcgtcaataattaaaatgtcagggtcaatatgcacggaaatcgcaaaaccgagacgcgatttcatcccgctggaatagtttttaaccggctgattaataaaatcgccaatctcggcaaattcaacgatgctgtcatacatatcatcaatttctttattggttaaccccatcatcaaacacttgagccggacattgtcccggcccgttaattggttatttaaaccggcagcaatcgcaatcagcgacggctggccgttcatttcaatttcaccgctggtcggcggaataattttagccagcaggttagacatggttgatttccctgatccgtttatccctacaaagccgattgtctctccctcatacacgtcaaaggagacattccgcacagcaaaaaaaccattatccttagccggaaaaaacaatccttttatcttgtccgattgttttttatacaaatgatattgctttgaaacatttcgaaacgaaacttttagtttcatcgtacaatctccttacgtattaaagaaagtcaacaaacttgtctctgaatttcatatgcagaatagaacccactaacaataaaaggaatgtgaacagccagaaatacagcgtatacttcatgtcttggaaaaaccattttccatctaagaagctgttcctaaatccttctatcagataaaaaatcggattcagcttaagcacaggcagaagattcgggtgatttttcccgagctgctctgagatattccaaaaaatcggaagtaaaaagaacaataatctggttacggcctgcagcagaaattgataatctctgacaagcacactgattgtagagttaaacaagctaaatgaaaacataaacacaatcatgcagattaaatagtaaatatattgtatccaatgcaagctagggtaaacaccgcttgctaaaaggacaatgacataaacacccatcattacaaaataactaaataaatttgaagcaatcacgacagaaggcagtgaactgattggaaaattcattttcgcaaccatattgatccgtttaaatacactgtttgatccatccagaatcgtcgggctaataaaaaaccacgggatcaaaccagccagcatccaaacaataaaaggcacttctccaatacctgttatgactggcttgctgttacgaatccccataccaaatacaaaccaatacgccagcatttgaatgagaggattgagaaactgccataatacgccaagataattcatctgatactgagactttgtctcatacgaagctaagcgcaaaattaaaggaaacgatgtcacttgctcttttacgattcttactaatgcattcattgtttatcttccttagacttaaatgattttttggatctttcggttaaagaaatttgaaagcaccggtgaatattgtaacagatattcattcatttttcatgtaatagtcgacagacccacttgttaatttaaaaatccaatatacaactaatataaaaagaatagttctaaaaaaagataagataacaacaaccttattttagaactattcatgtaattaatttttcatttggtcttctgatgtgatttttaataatctgttaaaaaattctctgtagtaatctgattcataatgagaataagataaaccataaggatatctttcatctcctataaactttgtatcagacaaatctattacctttgctgaaggggcaatagacaggaaataattatctaatttatcccaaaagtaattatttctccttatcattggaatatcatcaaatgtttttattttaccatccattccataatatgtttcggtaaatctgcccttattcaatataattttatcttcaggaataatggtttttaacttatcaagaaatttaccaatatttttcttccaaagctcaaaatacttctgattttcatgatgatttatgatgtgtatgttatcccaatttgataagaacttacttacttcaataaaatagttacaagtcacataattattttcctgagttctaatgaccggcttactcgcgtcgcaataaaaatcaataataatgtaatccggttttgcttctttcaactttacaaagaagtcttttttaaaatccgtttctacccatggccgatcactttctttaacatcattatattgattaaaatctatatctacaggatcagacatcaaactgatgactgatgaatggaattgtgtataacaacatttataaaattttttgtaatcagggttaaaaaatgatgacgaattgaatgcatttctgctaaaacaagtacctaaaacagctatattaagtgtatctgcatctttatttgagtcaaaaagcatatacaaagataatcgatttccaccatttttaaagaacttcactttatatccatcagctatattaaaataatcagtctcaatattttcattacagctaatataaacatagtctttactatcaattaaaatgaacacgtcccatacactcgcatgatcttttcttagcaattttaacaaattttctttgtctatctcacaaaaaaatcgatcaccgttatttagaagactgtattcttgagaaaaataatattcgaaaccatttccttttttctctctttttctaaaaactactttacattgtgaatttatcttagtatttatcttaatataaagccttacaatcttgtcattttcttcaaatgaggttaattgagcaatatttgtatcttttcgatatgtgtgcagagataatgagttgcttcctgttttgtttaatttgacataatgaaatgggtggcttctcagtgcacttaatttatcaagagaacttggcaattctttatcaactaaacaagaaagcaaaatagattcagaattattgtctaatttgatataaaaatcccaaatgtttgaatcgtcaacaataatattatccggaagattatataaatcaaggtcaacctcaaaatggtcatcagcttgagacagttttccaagttctatttgttcttcatgaaactgataaagggttccatgtggcctacgtgaaagaacgaataataaatcgttgttttcaaataatttatgcttctctccctttatttgaagtttcaaatgaaacttgtcaggtgaattaccctcttcaatactaaatatactaaattttgcattgtcaggctgtactgtaatgactaatttattattcactaatgagcaggccccaaaatacaaagaatctggttgctttatttcttgtttgtgttgaccatcgagacagctaattagtaattgggcatcttggtttaatactgtcaattcccactcattagagaaggcgagttttttcgactttattatatgagcaaatttcacttcacataagaaataaccttccttatgcatataagaataaggaagctttatctgaataggctgctcaaaggctatgttattagtctttaattttaaagccaggccctcaaattcctcgattctgtgtgtatgaccaaagattatccacccatcatttttaagatttacagaaatgttcattatctcaattttcacgatgaatcctccgtatactatttatttaaagactgagttttttaactggtccaaaaaattggtatagtaatccattgtataatgaacataaaatttgccccatggatggttttcatatgaattatattttttattttcgaataaacttattgcctctacatcactgaagctgtctaacacgtacgcatcaaatttgctccaaacactattataataatcaacatcaattatcttgatgtttcctccattaataagcaactttttcttatcttctttatcaaaaaaatgatgaacatttcttgcactatttaagataattttgatatcgggacaatttaatttcacatagttataaaaaagattaaacttttgtttccatagtgaaaaatacttttcaaaatgatcttcaatattaaagctttgctttttattttgaattgaaagtttataataatttgttttaggaagtgtccacctgttatttgtaatatactgattgctagaaatttctacgtaaccaaaatgcacatctgcaaaaaaatctaaaattaatatatctggctgaacagatttaatctcggttagaaagctattctcaaaatccgtctttaaagtgtttttttcatgattagacatgttctcattatcaataacaatgtagttaggtttactcattgttgaaataatggacgattggttttgggtcaatacacaatcaaaaaaatttttataatcagcattaaattgagagttaaaattatcccgtgtaacacaactaccgtaaaccgctacttttttcatttctttattccctctttaatattagttcctagactaataatttgttgataaacacgtttacagttttctttatccgtatacttataaaattgatttactctatcaatatatttggcatccattatacaatcgttttccatacaatttatcagcttatcaactaaagcatctttatcagcaattacttctccaaaccccattgaattgtaatcaaaataccctttttccaagtgatttttttcgtattggaagtaaaaaacaggttttttaagataagcaaagtcaaatgcaacggatgaataatctgtaactaaaatcgcactattattgaaatgatctcgataactttcattaatgtccgcaatcctcactgaactatttttgttgaaatctttcaactgctgaacaatatttggatgcgggaagaatacgatctcgtatcctttttcattagcctcattaataagtttagcatcatttaataaattattaagttcattaaaataaactgagtttttaaagagtggtgagtaatctcttttccctgtttgcggatttatttttcctactaaatgatttctccatgttggcataattaatatctttttatgattatgattaacaagcttatcaaatctaggaaatccagttagaattacttctctttttgaataattataatgaccattaattatagactcatactcaggttgagcggctgttataaatagtctaatatttttcttatacttattaagccatcccgaaatatcatctttcgtaattccatgttgcagaaaaacaaagttaaatttaaataagtccttataatatttcctcatattcacaaacgggttgactacataatcatctgcatgtgaagagataatttcatcggcaagtaaatgtaaaaatttgtgcttaggtgacccgtatgcaacaactggtcctatttttttcagcctgttataatctggactatctttactgataataaaatattttttgatgccgtcattctgctgcattgcatattcaaataatgcttcagcattatcatctgccttgttgattctatccataaaaagccatactcttttatttttctttattttatagaggtgttccataatctttcttacatttgatgctttctcagcacctattttattaaaggtcttaaaacgtctttgagcccgcttttcttttgctctaataatctgatttttatcttttagaactactaaattattaagtttatgatcgaaataaatccctataccatttttggtatagaaatcaactatatgtttatccagcgggaataatcgtccaaagttaatttttacttttattagttttccatttgatgaaatcatcatttcaatattcgagttatttgcaagctcaccaactgggatatcaaccttaaagcccaggtactctttaactggcttatttaagcaatataagttgtgtactgttctatcaattttttcggcatgatatattttgtcattgacacatgctttcacttctaattctgcggcatcaaataatgaaccaaaattaccttcaagggttaaaatccccttttcaatgcttaatagctccattgttatagcttcatatctcatagaattaattaatttctctttaaaatataaattcacattacgattcaaaaagatctttttaaatacattttttttatttcgatatttcaatttgattaaaaaatattttctgtgcaagtttagagatttttgttcaaagattatgtcgtcatctataaatgcaagtattctttctagcaagtcaaaaaactcttcaacttccttatccgtcaaaacatcagttctgtcttctatatttattctccactgcaagtcataggcaatcatatactgaatgtatcttggaacgtatcctaatgttgtaatactatgattaattaattctcgagagaaattcttcaaataatctacataccattttttatcatttttacctgtttgagttgcagatgacgcatcttctcttcgtcgataattatattgtccttctgacacaataccgtatacttggcgcttcattataattttagtcagccattcactatcttcagcgtaggccatatcttcattaaaaaagtgatttttaacagcttcttttttcacgaatgaacttggtgctgataattgaattcctgtatgttctttcaagatatgaactagcctagttttatcaaatttataatttaataagtgtggaccacttgttttaccaaacatcatcattggaatagaaactacatcgactttagaataattcttttcaaaaaaatcatatacttttaaaagggttgaaggggacaatgtatcatcaggatctaagaaattaatatatttacctttggcatattttaaaccctcattacgcgcactacttgctccgccattctccttatcgataaagactatattttctggatacgcttctttatactttaagcaaatttcccctgatgcatcaacacttccatcgttgactaaaatcaactgtatatgatgctcaaaatcaagtgcctgatcaattatgcttgttattgcttcatctaaaaattcttcaacattgtaaattgccattataatagaaaagaaaaaattcttttgttccaagttttcattctccttttgaattttgttttatagaaaagaattagattcgtattaacctcttaaataatttatttaaaacattgactttttggagataaacataatgattatctttttcaactataaacctaaaaaaaataactcctaaaggaatttttaattggtaagaagaatattttctatctctaacagtagttttccaaataacaatattcttttgtgtttgttcgtttaacttggcccttatgaatttttttccataagagatgtaaacattattttcatctttaattgcagattcttcattactcaaactcacagttagctcaatagaaaatttattgactctccatgaagtaattacaactttttcgttttcaatttttcctatttgaataagtttattaacaggataaccccatcgtttaaatgaaatcagatactcttttaagtatgttttcattttttgattgataattaacttttcatccatatattttaaaattttatataattctctgaagaattccagttgttctgtctcatctagtacttcataaatcaagttattgtttttttgaataataaataactttacatgatttagaattaagcattgaatataaggtattacctcaccgtattcctctaatgatcttttgatcatttcctcataaccatttttaagtaaaaaagtatacctattttttttataccatgaagtgtctacgagagaattttcctcttttctttttctatagaaatacttagcatcaggaataagaccatatttttgttctttaattaaaaaagtattaataaataaaacatcttcccaaaaatccatctgttcattaaaagaaattcctaaacgatctattgcttttttccgaaaaaatgttccaccaatgtgatagtgaacagaagagtaattatcagttatgtttacaatgtttttattacttttaaatctataattaagtgaatgctctccatttttattgtcaaagaaaaatagcggcagcaccgctaaattaatatcggtatgttttttaaaaaactttaatacttctgcaatagcatttggtgaaattttgtcgtctgaatcaataaagcctataaattcactattttcacaaaattttaatccattatttcttgctaaactgacatttggtgtatcttgataaataatttttatattattcggaaatgctgttgcatatttttcacatatgtttttcgaattgtcgatactattattttcaattaatataatttcgatgttttcttcaaaattaaaagtttgatcaatgatactgtcaatggcttcacttagatataaccccgaattataaacaggcattacaattgaaaacaacatttcaagtactcctttaaaagaaaatgtttttatccaagtatttcttcaacaacttttttagatgaatcacctttttccaaataacaaaattgatcataaaacgaagtaaggttttcatcctgcttatagtgctgtgttttgtgtatggcttcaattactttttctgttgttttaagaagaggtcccggagcacatttttcaaaatcatagtaaaagcctcttagtttatctctataaaattcaatatcaggaacataaaaaaggatcggtctatttaaaccggcaaaatcaaaaaacaccgaagaataatctgttattaatatatctgatattaaatatagctctctaatatcattatgatttgaaaaatcataagcaaaacccttgtacgcagttaagttaatattctcagatacaagatagtgcatccttaaaataagaatatattcatcacttaattggtctttaagactttctaaatctaaaaccatattaaatttatatttacctttagcataaaatgagttatctctccaagttggggcatacaaaataattttcttatctctatcaatacctaatctgtcttttatttttagcatttcttcatatttattttctttatgtaaaaagtcattcctcggatagccagattcaataaaggttcttttaaactgaaaagcacttctaaaaatctccgtagagtaagcgttaggggaaatgagataatcccatttactagcttctttcaggaagttttttttatattgttcagtcgtcgtgccgggcatatgtacttcgtccatgtcatttgcaagtttttttaggggagttccgtgccaagtctgcacatatgtggtttttctcggttttgggatccataacggcaagcggctgtttgttatccaatatttcgctgtagccatataccatagccatttgagagagaatctttttaaatatttcacatctaaattatcaaataaatctttgtttcttttatctatactccagattaatcggtaatcatatttatctttattttcctcaagatactcaaaaattgctcgtggattacagctgaattgtttgccggaatagctttcgaagatgattaatttttcattcctgggcaaaagcccaattattctaaaagcaattgagtatactctgaccaatagacttctatatttcattaaaatctttgatttcatcttagactccttaaatgttcgaacaattaaatacttatctcagcaaacaagaaaaaaagaagcaactgaattacttcaagcctctttaagttagtcttctataaactagccatgtcttttttgattttggtagttgaaatgccttctgttctcggaaggtaaatgacctcacaatattcctttaagaagtcaaacttccctttccaatcatcgccgatcacaaatgtatctatatcgtacttttgaatatctgagattttttgttcccagtttttttcgggaatcacttcatccacaaaatcaattgtttctaaaatgaattttcgatgttcataggaatgatgcgattttttttgtttttgaagattaaattcatctgtagataatcccacgattaagtaatcacccagattttttgctctttgcagcagcttcatgtgtccatagtgaaataaatcaaatgttccgtacgttatcactttcttcatcagataacatcaccttccaaccgttttcaactgagagtaccagaaaaaaaccacaaaccttaacagattgtttataatttcgacacattttttacgtaccattaatattgaacaataatagcataagttcctataaaagttaaggctctttaaaaatgtcaatcatcagcattttttggtatcatcgttgtattgatgtataatttttacaggtctaatgtcttatccatacccattataacaagttttctttttcgaaaaaatcgaatcttttgtcgcgtttttaagtgaaacgattttctttctgctgcgtcatttattttgtacgccctcctcatattaattcatcgtcaaaacgtgaaggaattgtaatgtgaatgttaaaagttcctaaagatttttgtggtaagatagagtaaaatgttttcagacaaagagtctttaatcaaactatacgaatgacacgtattttttatagacatatagatgaaaaggagggttgatacgatgcaaacaaaacccattaatcaattagattttgtagacggtgaactgacttcatttgtatcacatttagaaacgtcatttttggaccagaataaaggtgcgttcatcgtaacagcgaatcctgaaatcggatttgaagcgatgcaaaatccgcgttatgaagcggttctttcatctgctgattttattttgccggatggcattggtgttgtgttggtttccaagctaattggtaagccgcttcaatccagaatcgccggttatgatttgtttacgtctttgcttgagaaggctgatcaaaagaaaaaacgggttttcttttacggtgcagctaagcatgtgattgctcagacaatcgagcgagtcgaacgtgattatcctgggattgaaattgccggatattctgacggttatgtgaaaaatcaacgtgaggtggcagacaagatcgcagcctcaaatcctgacatggtatttgttgctttaggttatcctaatcaggagttctttatccataaataccgacatctattccctcaggctgtttctgtagggctgggcggaagctttgatgtgttcagcggaaatgtcaaaagagcgccctcattttttatccgttttcaccttgaatggatgtacaggctgatcacaaaccctgcgcgctggagaagaatgcttagcattcctaagtatgttacagccgtgctgaaacatgaacgaacttcagcaaagccgcaatatacgggacaggtcaaagatcaatcacgccatctgtaatgggccttaaaggagctatggtatgtaatgaaatgcatgaatctttcactgtgcctgccgacaatccgcggcagccgttttgagctgatgacagattgaaatcctggtttgcgtttttttactatgtgttcatcaaagtcatcggcgcattgctgttttgggttaaaccgggaagtcaagtgacccttcttgtttcctttcctgataatgcccgggcaatattaaaggaatatcagatgggacaatactcatttcccattcatgtacttctgacccagcatgccaaatcgctggaaacagaatttcctgagcttactgtttcaattattaacgaaaaacacccgcttcatatatataaagcggtcttttctatgctgagcagtaaagctgtgattgttgataactattttgttttgacaaccgttttgacctgcagacctgatatcgagtgtatccaagtttggcatgcgaatggagcgtttaaacgatttgggttaaaggatatcaacacacagaatcgttcgcgggctgacgtgagacgctttcgcaaagtgtatgcttcatttgaccggattgtcgtcggttctgaacatatggctgacatattcaaggaattcttcgatataaaaggtgataaatttcttcggtttggcgtgcctttaaccgatgcttactatgaggtgaaggaaaacagcaatgaccttaaaagcaaatatcacctgccggcagagaaaaaaatcatcctgtatgcgccaacctttagggatcatcagtttgaaagcttttcgctgccgttttcagaaaaacagctgcagcatgatttaaaaggagaatatttacttgcagtaaaacttcatcctgttatgaagcaatctgctgaattacctggggatagtgcgtggataaaagacgtatcagacctcccgcttgcagaccttttaaaaatgagtgatctgttaatatcagattattcttctgtcccttttgaatttgctttgctggacaaacccattttgttttatacgtatgatatggaggcttacaacagaacccgcggtttaatccgccattatacagaggtaatccccggggttccttgccgtgattcaggaatgctcttggaccagctgaaagatatgaacaggcttcaagctgaagtggagcgcttttcacgtgaatggaatctgtactcaagaggaaatgccagcaagctgcttttaagctatgtaaatgagaaatcaagctgatctttatatataatagagatcggtattgcaaataatatgaaaaccttttataaaacattatgagttgtagtaaggaaggagtcattttatgatttatgctgagattctagccggtggaaaaggttcccgcatggggaacgtcaatatgccaaaacagtttttgccgttaaataaacgcccaattatcattcatacggttgaaaagtttttattaaatgaccgtttcgataagattttaatcgtctcccctaaagagtggattaaccatacaaaagacattttaaagaaattcatcgggcaggatgatcgcctgattgtcgttgaaggcggcagcgaccgtaatgaatctattatgagcggcatccgctatattgaaaaagaattcggtattcaggatgatgacgtgatcatcactcacgattctgtgcgtccgtttctcactcatcgcattatcgatgaaaacattgatgctgttcttcaatacggcgcggttgatactgttatctcagccattgatacaattattgcttcagaagaccaggaatttatttctgatatccctgtccgcgataacatgtatcaggggcaaacaccgcaaagcttccggatcagcaaattggtcgagctttataataaactgtccgatgagcaaaaagctgtccttactgacgcttgcaagatctgctcgttagcaggtgaaaaagtgaagctggtccgcggtgaagtctttaacattaaagtaacgacaccatatgacttaaaagtggctaatgccattttacaggagcgaatttcacaatgattaatcaaacatatcgtttagtttctgcccgacaatttgaagtgacatataaagataaagttgtccattcagataaggtcgtcgtccgtcctacccatttatccatctgtgctgcagaccagcgttattatactggctcacgcggcaaagaagcgatggacaaaaaactgccgatggctctgatccatgaagggatcggaaaagtcatgtttgatccgacaggcacatttaaagtcggaacccgggttgttatggtgccaaatacaccggttgaagagcatgaagtcatcgcggagaattacctgcggtccagcagattccgttcaagcggttatgatggatttatgcaggattatatgttcatggcgccagatcggcttgttgagcttccagacagcattaatccgcatgtcgcagccttcactgagcttattacaattgcagttcacgcgctttcccgctttgagcgcatggcgcataagaagcgtgacacattcggtgtctgggggacggaaatctcggatttatcatgacgcttctactgaagaaaaaatatccagacagcaaggtgtttattttcggaaaaacaccttacaagcttgatcatttttcttttgttgatgcagcttatcaaattaacgacattcctgaagatgtcagaatcgatcatgcctttgaatgcgtgggcggacgcggcagtgaaagcgcaattgagcaaatcattgcccatgtccatcctgaagcgtgtgtagcgctcttaggcgtatctgaataccctgttgaaattgaaacaagaatggtgcttgaaaaagggattacgctgatcggcagcagccgaagcggacgcgaggattttgcccgtactgtagactttttagctcaataccctgaagtcgttgattatttagaaacattagttggcggacgcttcccggtacgcagtattgaggaaattacaaacgcgtttgaagcagatttgacttcatcttggggaaaaactgttattgaatgggaaatttaaacagtgaaaacattccttacgcgaattgtaaaaggagtattcggcactgcttataaactattgagcgctttattaccagtacagcacaacaaaattgtcatagcttcctatcgtgaggatcatttaagtgataattttaaaggtgtctatgaaaagctgaagcaagacccgtctcttcgcatcaccctgctgttccgcaagatggataaggggctgatcggacgagctgcatatttgcttcatcttttcagctcgttatatcaccttgcaacatgccgcgtgcttttgttggatgattattattttcctttgtatgttgtgccaaaacgaaaggaaactgttgccatccagctttggcatgcttgcggcgcgtttaaaaaatttggctacagcattgtgaacaagccgttcggcccttcttctgattatttgaagattgttcccgtgcattcaaactatgattatgccattgtcagtgcacccgctgccgttccgcatttcgccgaagcctttcaaatggagcaaaagcagattttgccgctcggtattccaagaacggattatttttatcataaggaacatattcgcactgtactggatgagtttcatcgggtttatcctgaactgaagcataaaaaaaagcttttgtatgctcctacttttcgaggcagcggacatcatcaagagggtgacgctataccgcttgatctgctacaattaaaatcggcgctaaaccataaagattatgtcgtgatcctccatcttcatccgtatatgcgcaaacatgcgcacacggaagaggatgattttgtgctggatttaactgattcgtactctttgtacgatttaatggcaatctctgatgggctgataaccgattattcttcagttattttcgaatacagcctgctgaaacgtccgatgtatttttactgcccggatttagaagactacttggaagaacgtgatttctactatccatttgaatcgtttgtacccgggccgatctcgaaagacgttccatcgcttgtacatgatatcgagagtgatcatgaggctgatacgaaacggattgaagatttttcacaggcatttatcacccatcaggacggcaaatcttcagagcgggtagccgattttatttcatcatttttaacatctggtgccgattaggagaaagtgaggtacaaagtgaagctggcaagaaagattaagaacagacttttcagatcaaaaaagaaaacgcaaaaagaaaatgcagctgtcattgtccatccagctgataacagggttttttctctatttgataaaacgaagcgaattgaagaaaaccagcaagtccctgtcagaaagatttctgagttttcttggaatgggtcaattctaaaaattgcgggttatatgtatatcaagggcctgccgcttcaaaaagaggatcaggttcgaaaacgtttattattggtgaacaacggtgttttatttacagctgtttcactgcgggatgttccggtagataagctgtcaattgatacttcaaatgtgcctggagcctataagtgggcaggattttcacagcagattaacttttctaagctgatgaatgacaaacctcttccgcagggcgagtataagctgtttctcgagattgaagctgtagatgaccaaaatgtaaaacatcaggaagtgcatacagtcggaaatgtaagtaatttcctttctaatgatgtgtatgccacaaaaatggaatttcattctgctaaaaagctgatgaagttcaatttgatcgttaattatgatgagggcgaaaagacgattaatttgtcttgcaacaaactgcaggaaattgatccgagccttttggagctggatactggaaaagaggcaaaccgctttttgcgcaagctgaatacaagcttgttccattttgcatatgatgtgttccgtctgctgccgattaagtccaataagattgtctttgcttctgacagccggcttgatatgacaggaaacttcgaatttgtttatgaagagctgctgaaacgtgaagaaaattttgatttcaaatttttcttaaagagcagcattcgagatagaaaaagcctgtctgaactgatgtcgatggcttatcattttgcgacaagcaaaatcatttttatagatgatttttatccgattatttatccgttaaaaatccgtaaaaatgcggaccttgtccagctgtggcatgctgtcggcgcctttaagacattcggctacagccgaatcggtctgccgggaggaccgtcaccgcattcgaaaaaccatagaaactacacgaaggttattgtcagctctgaaaatatacggaagcactacgcagagggctttggggtagacattgagaacgtcattgctacgggcgtaccgcgaacagactttttctttgatgaagcgaagaaggcatttgtaaaagaacgcctttacacggaatatccgtttctaaaggacaaaaaggtcattctttttgctccaaccttccgcggaaacggtcagcaatcagctcattatccttttgaagtgcttgattttgaccgtctgtatcgtgagttaaaggatgaatatatcttcttattcaaaattcatccattcgtacgaaacgatgccaatataccttatcagtacagcgatttcttttatgatttctcttcgttcagggaaattaacgagctattgctcgtaacagatattctgataacggattactcttctgtttgctttgagtatgctttattaaataaaccaatgatcttcttcagctatgatgtagatgattatattcgcaaacgtgatttctattacgattactttgactttattcctggccctcttgcgaaaacgtctgagcaaatgatttcgatcattaaagaagagaagtataactttgagcaaattgattcatttgttcattatttcttcgatgatcttgatggaaaagcaagtgagcgagtcgtcgatcaaattgttttccctcaggaagaagagccatcagaggataaagttcttaaaagataaatcaaaaacaccttttgcagccgcaaaaggtgtttttttattgatattccggaacatcaaagtaaagtgtatagccgtccagcaatgaatacaggctgtacatgcggtttacttgtttgtacgcccagccgatgtctgttgcgtattgatgtgtcgctgtagctgaccatctcattttgtacagtgtgtcctgattgtaagctgtgttgtggatatacgatgagcctatgaattttgctccgccgataatggccgcttctggtgtgaaccagccctgctcgtacgcatatttggctccgtagtaattcggattgctgtcgtatgctccaattccatacatgttgtatacggtttttccgttataggttaatccattggctaaggcggatgtcccgtttcctgtttcaagaagagcgtgtgagattaaatacagttcgttgatgctatattgattggcggcatcgataaatgcctttgctctccctgtcaggatgcctttacccgcaagcactttctgattgacctcagtaacgctgaggcccgctgtctgtgacagcttgagaaattggaagtagtatttgctgtctcttgtaaagttatttggatccacgtattgaactacttcatcactgcttgcgtttcgccagcccaaattgatcttagcccagccgtttatctgtccgatgattttcactttatcgccttttttaaattggccgatcacgtttgtcgggctgacttccggcgttgaccggatatttagtacatcagccgtaacggttgatgttgctgtattaatgtacgtgagcgatacgtaagccgctccgtctgtttgcggacttactgtcatttgtttttggaccatatcacgaagcgagagattgtagtttgttttcatgatttgcgggccgtttttgatcttcacgatagatgatgtccatccgtataattgttttagcttcgttgatgccgcagcagctgtatcattgcctgtgaactgctcatttacgctgattttataaagcgtattgcttttcgttgtgtagctcggggttacacttttcgatttaagataggttaacccattgttcaatgctgttttgctgctgagctgtgttgtcacgattttgtattgtgtatatgcagtctggcctgtttttgatgttgtgactgcgatatgattttgtttgaaaaatgttaaaacgcggtcaatctcttcttggctgatgatagcttcagttgtgatttgatagctgctcgcagctgtctgaccggttttctggcttgctgctgatatatgattcgatttgaaaaacgtgagtgcctgattgactttcgtttgatcaagcagagattcggttgtgattttaaacgtgtcagctatttgttttttgacggatttcgcagaagcacttagctgatttttctttaatatgttcaaaccctttgtgacttttgcttgatctgatgtttcttctgagatgagctgatattgattttctgctgttgatccagctgctgtttttgcagcttttacttttttctgagcaaagaaggctgctgctttgtttgcttgctgctcgcctaaaatcttagccgtcgtgatttgataagctgcagacgttgtcgtttttttgacgctggatgacgtgtaatgccattttttctttttaaagaaagtgtctattttttggagctgctgttttgttacacccttcatattcacggtatatgatgtgctttttccaacctgttgataactgccggatacgccggtgtttttcttgatttggctgatagcatcctttactgtattcagccctttgaaataagctgattggacattgtatgactcaacggttgttttttgattgatggacttgtagctgcctgtgatgccagtgctctgtttcagctgctgcaatagagtcttggcattcgcttcacctgaaatggcggcagttgtgaacgtataataggcttgtcctttcaccgtttcctttaatgatgcatgcagccccgactccttttggaaggcgtttttgatctgcgctgctctgctgtctcccacgattgtgccagactgaatggttgtgacagacaccgtgtgtgtgatgggctgatacgagcttttaatccccgtttgcttagccaggctctggataagcgccttgacttttgtctcatcagcaatgtctgatgtcatgacgttcatatagggctgagctgctccgtaagcttttacagcgccagccactcccgtctcctgtttcagctttgctaggatagtgttggcctgtttttctccggagatggcacctgacgagatggtgacatatggctgtttgcttccaacaggacttgacgttcctgtaatcgatgtctgtttggcgagtccgctcagtattgctttcgcttctgattcgctatggaagcctgaggcggaaatttggtaggtcgttgttgtgcctgaagcctggtaggatgcatcccagccagtatctttttccagtttggcgacagcttgtgaggcttggctttctgtactgaacgtattcgacggctctactttatatagtgagtagtcggtatacgcggctgcctgggcagaaccagacatggcaaaaaaggcaagggacgcggcggatagaagcataggtgcgattagtctctttttcattccttctcctctttcttattctatgagaatataaaactagtttatttatcggcacgcgcatgcttcatttataggtgaatcacttccattttctaataaaaaaaacttaatctcgaagtgagattaagtttaaatatgagacacgataagggtacaagttccttttatcgtaaaatcgggcatttgagccggcaaaataaagtgatcgccttttttgagcggacatgttttgtcctcatacatgagcaaaccgcttccttctatcacgctgcaaatcagaaaggattcatcctgagccatttcagcttcgccattgatgtcccatttataaaccgaaaaatattccccttggacaaatgttttaatggttattccttttcttgattctgtcgattcatctatatacccgtccacatggggaaccgtggccgcattgaccgctttggcaaaatgaagctctctcggacttccgttgctatcaagacggtcataatcgtacacccggtatgtggcatcagaattttgctgagtctctaaaacaagggcccccttgcacaatgcatgcagcgttccgctcggcacataatagaaatcacccggtttaattttgattcttcgcagcaggccctcccagtcaccgctgttgatcattgtgacaagttcggtttttgagcgggccgtatgcccgtaaatgatttctgcgttttccttacagtcgataatgtaccagcattccgtcttgccgagttctccctcttcgttttctccggcatagtaatcatcagggtgaactttaattgacgtaccttccttcacatccagcagctttgtcagaagcgggaaccgatccccctctacaccgccgaatacttcacggtgctcttcccaaagctcgatcaatgtctttcctttatacgggccatttgcaacagtgctcggtccttttggatgagcggaaatggcccagcattcccccgttgattctgaaggaatactgtatccaaatctatctcgtaaagcggttccgccccagattttttctttaaacacaggcgttagaaaaatcggtgattgcgtcatgatccgtacccctcccctgtaaataactgatcatcattttcccggtgcgcccctcttacaaacgcccgtataagctgtctttttccgatgacaacatatgtacaaagcatcatcttttcattaccccttcaaagaaaacgcttcctatctattatatcacgtcgaaaagaagctttgtttcagccttttcctcgataagaataattctccttttttgatacaaattaataaaaaccgtcaatctgtttacgaaggagagaaactatgcaaatcgactctgatctccagaacaatttagacacactgaaaaaaacattgggacaaaacgacgatatgatgttttatacatttgctttcggagatagcagacaaaaggcgtgtttactgtatattgacggtctgacagagaataaaatgctggcgcaatacgtcatttctcctttacaaaaagaggcgttagcccataaggaaagctcgattgaagacttatccgccttttttttcggctttcaccacagcgttgtttctacaatgaaagaaatagagcaactcgttttttcagggcaagccattttgctcgctgatggctatcgcggaggattagctttcgacacaaagtcagtcgcaacacgcagtcttgatgaaccctcctccgaagtcgtggaacgcggccctaaaataggatttattgaaaaactgcggacaaacacggcgcttttacgtgaacggacgagtgaccctaatcttgtcatcaaagaaatgacactcggaaaaaggacgaaaaagaaaatcgctgtcgcttatattcaggatatcgcccccgattatgtcgtcaaagaagtgtttaaaaggctgaaatcagtcaatatagataatttgccggaatcggggacgcttgaacagctgattgaagacgaaccattttcaattttccccacgattttaagtacagaacggccagatcgtgtagaggctgctctattagaaggacgagtgtccatattagtggatggtacgccgtttgctttgattgtaccggctacggttgacgaatttattcattcgcccgatgattacagccagcgctggatcccaatgtcacttgtacgccttcttcgttattccagcatcctgatcaccatttatttgcccggtctgtatatttctctcgtttcttttcacaccgggctattgccgactagaatggccatttccattgcaggcagcaggcttaacgtaccgttcccgccttttatagaggcctttatcatgatctttacgatcgaattgattcgagaagccggattaaggctgcctaagccgattggacagacaattggccttatcggcggggtcgtcatcggacaggcagctgttcaggcacaaattgtcagtgcgcttatggtcattgtcgtttctgtcacagcactggcatcctttaccgttccttcatacgcctataactttccgctgcggatcattcggatcggggttatgataagtgcaacagcgcttggcatgtatggcgttataatggtttatctgtttgtgatcggccatctcatgcgcctgaaaagctttggacaggattacattatcccgatcatggcgcagcctggacaggatttgaaagacacagtcatccgtattcccacgatgtttttaaaaagaagaccgacacgaaacgatcctgaagataacatcagacaaaggtgatggctatgaggaaatcagagcataaactgacatttatgcagacgctcattatgatcagcagcacactgatcggtgccggggtcctaacccttccccgctcagctgccgaaaccggcagtccgagcggatggcttatgatactgctgcagggcgttatttttattatcattgttctgctttttttgcctttccttcaaaaaaacagcgaaaaaactctttttaagctcaacagcattgtagctggaaaattcatcggctttctattgaatttatatatctgtctatatttcattgggattgtttgctttcaagctcggattttgggagaggttgtcggattctttttgttgaaaaatacgccaatggcagttgtggtgtttatatttcttgcagttgccatctatcatgtgggcggaggcgtttattcaattgcaaaagtatacgcttatatttttcctataacccttattatttttatgatgcttttgatgttcagctttcgcttgttccagttcgattttatccggcctgtttttgaaggaggctatcaaagttttttctctttattcccaaaaacacttttatatttctcaggatttgaaatcatcttttatctcgtcccatttatgagagatccgaagcaagcgaaaaaggctgttgcttttgggatcgggacttctacagtgttctacagcattactttgttcattgtgattggctgtatgactgtggctgaggcaaaaacggtgacatggccgactatttccctcatccacgcattagaggttccgggtatttttattgaacgatttgatctgtttttacagctgacctggacagctcagcaatttacctgtatgctcggatccttcaaaggcgcccatatcgggttaacggaaatctttcatctaaaaaataaaaacaatgcttggctgctgactgcaatgctggttgcgacgtttttcataacgatgtatcccaaggacttgaatgacgtgttttattacgggacgcttcttggatatgctttcttaattgtgattgcaattccattcttcgtctggcttttaagctgggtacagaaaaaacttgggaggggtcagctgcaatgaaaacagcaacaaaactcgcagtcatgtttcttatgctgcaggttctctgcgggtgctgggatgtcaaaaatattgagaaactatccttcgccagagggctggcgatcgatgagacagatgatcaccagtacaaactgacgtatcaaaaccttcttccccaaagcgaagacagccaagcatccggaaaacccgaatttgtcaatgtgacgtcctacgggaaaacgatcctggaagcagtcagtgatgtatccatcaaggaccctcctgtttatagcgatcatttaaaagtgattcttttgggagaaaaactgatgaggaatcaaaatgtagaccaagtcttcaaccactttatccgggatgatgagctgcggcgaagcagctatttgatggcagccagagggaatgcagctgatgttttcacaaaaggaaaccccaatcagcagcagccgatgccctcagaaaaactgattgatttgacaactcacagcggatataacggtaagattatgataccgctgcgcatcggcagagcatctatatactctcagaacgggtacagttatcttattcaagccgtgaaaaaccaaaagggaaaagccaagtatgacggttcaggcgttatcaaaagaggcagcaataaactcgttgggtttctttcagctgatgaaacccaaacactgacatgggtcatggggacgatccaaggcggtgtcatgccaacgacagataaaggacatccgattacgtttgaaattaaaaagtcgaaaacgaaaattaagccggtcattgaaaacggaaaacctgtctttcatatttctgttaaaacgaagggcatcctgacagaagaccaaaacccgaatgaaaactcgttcagcaaaagttatttgcacaggctggaaaacatttttgaaaaaaagcttgaacgagatgtaaagcaggtgatggataaactgcagcacgagtataaaaccgatccggtctttttatcagaccacataaggattcaacaccctgactactggaataaagtaaaagggcattgggatgaaatattttctgaggctgattttaagtacgatatttcttttaaaatcattaactttggcacggtgggaaagtaagcaatcaaaagggtgcgcatgatcgcgcacccttttttatgtcccgacagtctgctgttttccggccgatcctccctgtccgtttttgtcccgtaaatcctgctcaatttcttcaaggctttttccctttgtctctgtcactttaaatcggacaaataagaacgccatgataccgattgcggcataaatcaggaataaataactgattccgatcgcttccattaatattggataggttagtgaaacaatcagtgtcccaacgtgcaacattaaggtcgaaacaccggtcccgattcctctgacatgaagcgggaacaattcaggaagcatcacccatacaaccggtccccagctgaccgcaaagacaacgataaacacgcctaaacaaatgacggtcgtccatgaggcagccggagtgttatcgaaaaagagatttactaaagcgagaacgatcaagctgatcaccatgcccgcattcccgaatagcagtaacggctttcttccaatcttgtcgatgattttaatcgctactaatgtcatgacaacattgactgtgccgattccgaccgtgcctaaaatcgaagcggagtttccgaatccgacgtttgtaaaggtctttggcgcatagtagatgatcgtattcgttccgataaattgctgcaaaaaagcgagtcccaaaccggcaataagcgctgggcgcacccatggatcgaacagctccttcaggccgccttcatcctgcttttccgcttcttttatatcatgtatttcctgatcaatatcttttgtgccacgcaatttttcaagaatgttcttcgctttgctttcttcgccattcgtgaacagccagcgcgggctctccggcataaacaaaatgccaatgagcaagagcaatgacggcacagcagccaatccaagcatccagcgccacgcttcggcatcggcaaatatgtaattgacaatgtaagaaagaaggatgccgaccgtgatcatcagctgattcagtgatgacagcgccccgcgtttatgttttggcgccagttcagataaataaagcggcacgatcgtcgtcgatgttccgactgcaagtcccaaaatgatgcgaaacagcaccatgactcccgtattcggggccagcgccacaccaagaccgcctatacaaaacagcagcgcggccgccataattgctttttttcttccgaaacggtcagtcagcttgccggccgctcctgagcccaatatcgccccaaccagcaaggagctgacaacaagaccttctgtaaacgcgtttaagcctaactcctttttcataaataaaatagctccggaaatcactccggtatcatagccatataacgcgcctccaagagctccgaaaaaataaagccatatatttgactgctttttcataaaaatgactccctttctccatcagctgcaatgacattgtctgtgggatttttttagaaatcttttagcctctttttccggccattaaacctttttattttgctgatcataagttttccaatcatttacttgtatttttttcaatgtcgccgaaacattttacctgctgcggcgtccaatataaggtgattcagcacattatcgttatcaattttcaaaaacaagaacttataaatataggaatatttatcgaaaaatgtctttcgaggagttgccccatggcaaatagaatggtacgcttcaaatattaaagaaacgtgaggtattgatatatggaagaacgatcacagcgcagaaagaaaaaaagaaaactaaaaaaatgggtgaaagttgttgccggattaatggcttttttagtcattgcggcaggctctgtcggcgcctatgcttttgtaaagctgaacaatgcttctaaggaagctcatgtcagccttgcacgcggagaacaatctgtaaaacggatcaaagaatttgatcctggaaaagattctttttctgtattgctcttaggaattgatgccagggagaaaaacggcgagaccgtcgatcaggcaagaagtgacgcgaatgtgctggttacatttaatcggaaagaaaaaacagctaaaatgctgagcattccgcgtgacgcctatgtaaacatcccaggccacgggtatgataaattcacacatgctcacgcttacggcggcgttgacttgactgtgaaaacagttgaagaaatgctggatattcccgtcgattatgtcgtagaaagcaatttcacggcttttgaagacgtcgtaaacgaattaaatggcgtcaaagtaacagtaaaaagcgataaagtcattcagcaaatcaaaaaagatacaaaaggtaaagtcgttcttcaaaaaggaacacatacgcttgatggggaagaagcgctcgcttacgtaagaacacgtaaagcggacagtgaccttttacgcgggcaaagacaaatggaagtgctgagcgccattatagataaatcaaaatcattgagctcaattccggcttatgatgatattgtggatacgatggggcaaaatttaaaaatgaacttatcccttaaagatgccatcggcctgttcccgttcatcacttcattgaaatcagttgagtctattcagctgacgggttatgattatgaacctgccggagtttattatttcaaattgaatcagcaaaagctgcaggaagttaaagaagagctgcaaaacgatttaggtgtataatgaacgggatggcgattacgccatcccgttttacatatttccttgttgaaaattatcaaagtaacgtttagccttgatttatatggattatgtttcacaggcaagctgaacatactacacgaagcagcttcatttttaaggaggttcccctacatatgaaatgtattgcgattgatctagacggaacattactgaataaagaaagcgtcatttctgcggaaaacagagaggcgatcaagcgggccgttgatgccggcatcctcgtcaccatttgcacgggaagagcgacatttgatgtaaaagcgctgctggatgacttggacatccctatcattgcagctaatggcggtacgatccatgacacgggttaccgtttgatcagccggacattaatggatcaggaagccggtaaagcgattgctgattacttactttcaaaaaacatttactttgaggtatatacagatgaccatctgctttctccttttgacggcgaagctaagctgcacgcggagcttgacattctaaagagcgcaaacccaaacgagcagacggatgacttgtggcaaggagccatgactcaattcaaacagtttggcattaaaccaatccctcatatcgaatcggtttttgacggcggtgaaaacatttataagcttctttgcttctcctttgatatggacaagctgaaacaagcgaaggaagaactgaagcatcataaaaaactggcgcaaacctcttcaggaaaacatattatcgaaatcctgccggcctcgtcaggaaaaggacgcgcgttaacaaagctggctgacatatacggaattgaaacacaggatatctatgcgatcggcgatagtccaaacgatttgtccatgtttgaagtcgccggacaccgtatcgccatggaaaatgcgattgatgaattaaaagaaaaaagcacctttgtcacaaaaagcaatgacgaaaatggtgtggcctactttatagaccagcttctttcggggcaatatgcataaagaaaagactccagagattggagtctttttcttttattgcacccgtatacttcctgcgtatttatccttccaatatgtgctcgtgttcatattggtgatggtcacgccgtttgataatgtgacatgaacaacttgtccgtttccgatatagatggagggatttaagcttgttgattgaaagaacacaatgtctcccggcttcaggtccgccttctcaatcttagttccggcattgtactggcttgttgcgtatcgaggcagggaaataccggctgctttctggtagacatattggacaaatccagctgtatcaaatcctgtctcaggtgttactccgccctgtttgtaaggcacttctccgacataaagcgtcgcttcggaaacaatcggattttctttcgggattgtcaggttgtcaaatcggcgaatacccgtcatcttcgatttccagtaatcctctgacaaataggaaatggttactttttctgaccggcttgcctgaatgaacctgcctgcgcccgcataaatgcctgcatgtgaaattcccgttttatacgtattgctgaaatagacgacatcaccaggctttatgttctgaggggctaccttctcgcccactgcccactgctgttcggctgatcgcggcagataaatgccgagtgcctgttgaaacacatattgcacaagccccgagcaatcaaagccctctgacggcgtacttccgccaaacacatatgggacaccgatatatttttcggcctcctgaacgacaggaacatcagccgttgccggatcggcagcgattcgtctcgctccgatataagttccgctccaatagctgctttttttgtaattggtgatgataaccccttttgactgtgtactgtgaaccatttggccgtctccgatataaagggcgtcatgtgtcggaacagtgccggtgcttccctctttcttgaaaaataaaatatcacccggcttcaagttttccggctttacagctgttccgattttatactggtcgtttacagatctcggcagatgaatatcagccttactgaacacatattgtatcaatcctgatggatcgaaaccctctttcggcgtttccccgccatatttatactgatatccaagcaggttttttgcttcgctgacaatcaattctgatgatgtatcagcttccgcaatctccgcttttgtcataattggaaccaaaaaacaaatgataaccgccacaagcaaaaacttcttccagtttgccagtgtgttcacttttattatctcctcctctttttgcagttttaacatcggtatttttttgaatatgttaagagactttttaatatttttacagaatgaatatgctgggcaaacaaaaagagagtgtctcatcagacactctctttttttgaattatttattggcgtttaccggttcttcctgctgctggattttattcatttccatatcaatcttctgtttttcctgatctgtcagctgatcattgaatttaaaagctgacataaacatgaacacgatggctacggcaacaaacggccaaatggctttgacaaatttcatctttatcactccgtttatttagattttagtttgtcactatgatcaatatcaaacgtcagttttccgtcttctactttccaagcgaaattagagtctttcgtcagttcgcgaataatggttttctgtttaaggctgtcttttttcacaggtgcaggtgtcgcttcatggatatcgatcggtgtcacttcaaagcggcctgttccatttttcttcaggtgatactgaaccagtgcactgtctcttgttctcgtccagccctggtcaaagacaaagttgccgaggctgtagaaaatgacggttccgttatatacttcaatcggttctaagacgtgcgggtgatggccgacgatgatgtcagctcccgcatcagacatggctcttgcaagctggcgctggcggtcgtttggatcattgtcatactcttggccccagtgtgactgcacaacaacgatgtccgcatgttttttcgcttctgaaatcatagggatgaagatttcaggatctgcgggcagcacgcccggcgtattctttttagccgcgaaacctttcccggacacatcggtaaagccaagcgtcgcaatcgttaccccgttgactttctggtacgaaattttctttttcgcatcacttaagctgtatcccgctccaacgatatcaaggttttgcttcgcaaattctccaagcgtatctttcatgccctgaacgccgtaatccattgcgtggttgtttgcgctgttgagaaccgtgaaattcatatccttcaagactttcactgattccttattcgtctgcagatgaatctctttatctgcttgtttataattcttttgataggttaccgggttttcaaagtttcctgctacataatccgaggctctaaagatcggttcaacatattgaaaaatactgtctgcccctttttgctccgttactttttcaacatagcgtcccatcataatatcgcctacaaatgaggctgagagtacgtcgtcagaatacgttttgaccttcggcgtttccgcttttcccgcccacatgaaagcgaacataaggacaaaaacgatcggaatggcaataaatacgtgcttattggttttctttttttgctgttttgtcagctttagcagcttttcatgaaagctcagttcttttttcatcgtttgacacaccttacattaaattaagtagtaaacaaacatgatagcaaaggtcgctccgctcaatagcagcgtgcttccgaacgtaatggttaaaccttgtttctgaatggtattggcaattaaacctggcacgatgatgccgattcctcgaaattctgcgatttcaaatggtacaatcgggtatagaaaatcaaacgcgatttttaggacgatccctgttatcagcatggcagcgaattttctgcgtccatacaaaatcataaatttggataaaccgtatttcacaataacataagtgagcaagctcactagcaaaacaagtaaaataaagaccggctgattaaacacaagtcctagatatcccggtacaacaagtcctgccggcacgatccctgttttttccgcaaaaattaaactgagtagtacacctaaaattagtgcgatgtataaatctgatccgaacatgtttgcatttccccctagcttacgagctgcttaaccttgtattcgtggattttttcaattaaaggctctgcggcaccatgaatattgccgacgccatatatgacacggttgtgcattcttttctttaacaattccataatttcatctgttgacttatactctagatcatgcagtttgtctgcaggaattttgccttcttcgtaggcttttacgatcggttctgttgtttcaccgattaagatcagttcacttgcttcaatataaggcaatacgtcatttgcgaattgctgtgtccgatcgacacggtctgcgcggcagttcatgatgatgatcggatcatcggtcgggtaaccgatttcttttacacgtttccatatattcaaagtagaagaagcgtcgtttgcggcaaacccattaacaaagtgcccaggctcgctcggactgatcagcggaagaattctcattgctcccggatctggcggcgcattcagcattcccttaaatgctgtttcttcgtcaatgccgagtgcttgagccacacccagcgccagagaagcgttatcagggaataccatgtattcaaatttacgtaaatactcatctgtaatttttgagttatcagcaatgatgacttttgtgtttcgttcttttgctttttgtttaaagaactcggtatattcactatctgtaatgacaagatggccattataaggaattgtagcggtaaacgcttctgcaatttcatcaagcgtcggccccatgacatccatatggtcttctaaaacattcacaatgacgccgatattggcctgcagaagttcttcctgaaagatgatttgataatctgggttaacagccatgcattcactgacaatcgcgttagcccctctttctactgtttctctcatgacttctttttgctctccgatattcggcccctgaggtttccgtttaatcggcttttcctccggtgtgtcccagtaaatcattcttgcatctgttcctgttgtttttccaacagtcttgtaaccggcttctattaatattccggttgtcagccttgtcacagtcgattttccgcggatgccgttaatattcacccgaacagggagggcatcaatgtttttctgatgtcgtcgtttttctaatattccgatgaccagtatgacagcacaggctataatgagtaaccacattgcttttcgacatctccttctatattgttgtaaattcattcatcagtatatagaatcactatgaattctcaatcggcattatgtaacataatcttccctaatcgactaagccaaacttctcttttgaaagagattttatacctacaaactgttttctatttttggaaaacagcaggacttataccttatcacttttttgaaaaatcgaagagaatgcgctttcatttttctcctgatatccttctggacgtatagtcacaccctgctgtttgtatttaatatgcatttcaaatcaatctttttttcagcctgtgttatcaagcatttcctgctatcatgcgtgtttccggttcttatgaacacaaaataattttatcctgtttcttaaggacaaggtcataatgtcatcctttctgcatggaataagcaatattaggcccattccaaaatgactaaggaggttcgagatgaaaacgctaaacatacgagtccgaattctctaacataattaaacattttctgggatgatagtcttttctgtttctcaccatttacaggtctaaacgcatgactttgaaacaattttaataaaacttaatatttgttcaagaaatcttcatccatatttgtgaagactttgtcaaaaaaagagtgaaaaccttaattttttcaattatatatacaatttacaattagatttcttttgatatttttattgctaacttcggattgttcatgataatctatctatgtaaacggttacataaacaaggaggagctgttttggctacaattaaagatgtcgccggagcggcgggcgtttcagttgcgacggtttcccgcgtcctgaatgataacggctatgtacacgaagaaacgcgaacgcgtgtcatagcggcgatggcgaagctgaactattacccgaatgaagtcgccagatctctatataaaagagaatcccgactgatcggacttttgctcccggatatcacaaaccctttcttccctcagcttgcccgcggtgcggaggatgaattgaaccgggaaggctatcgccttattttcggcaacagtgacgaggaattgaaaaaagaacttgaataccttcaaacctttaagcaaaatcatgtcgcaggcattattgccgcaacgaattacccggatctcgaggaatacagcggcatgaattatccagttgtttttctggacagaacacttgaaggggctccttctgtgtccagtgacggctatacaggaggaaagttagccgcccaggctatcattcacggaaaaagccagcgcattacgctcttgagaggccccgctcacctgccgaccgctcaagaccgctttaacggcgctttggaaatcttaaagcaggctgaagttgattttcaggtcattgagacggcttcattttcaattaaagatgcacaatcaatggcgaaggagctgtttgccgcttatccagcgacagatggtgtgatcgcgagtaatgatattcaagccgctgccgttttacatgaagcattgcggcgcggaaaaaacgtgccggaggacattcaaattatcggctatgatgacattccgcaaagcggacttctgttcccgccactttctacaattaaacagcccgcatatgatatggggaaagaagctgccaaactgcttttgggtatcatcaaaaaacagccgctggcagaaacggcaattcaaatgcctgtcacctatataggaagaaagacgacaagaaaggaagattaagatgcgtaatatttgtgtgattggtagctgttctatggatttagtggtcacctcggacaaacgcccaaatgccggtgaaacggttcttggcacgtcatttcagactgtgccgggcggcaaaggagcaaatcaggccgttgccgcagccagacttggggcccaagtgtttatggtcggcaaggttggagacgatcattatggaacagctattttgaataatctcaaagctaacggcgttcgcactgactatatggaaccggttacacatacggaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatggtgctgattcagcaggaaatcccagaagaaacggttgatgaggtgtgcaaatactgccattctcacgatatcccgatcatactaaacccagcaccggcccgcccgctcaagcaggaaacaattgatcacgctacctatctgacgccgaatgaacacgaggcttcgattttattccctgagcttaccatttctgaagctctggcgctttatccggcaaagctctttattacggaaggaaaacaaggcgtccgctattcggctggcagcaaagaggtgctcatcccgtccttccctgtagagcccgttgatacaaccggagccggtgatacgtttaacgcagcatttgccgtggccctggctgagggaaaagacattgaagccgcattgcggtttgccaatcgtgccgcttccctttctgtctgctccttcggtgcccaaggcggaatgccgacaagaaataaagtagaggagctgctgtcatgaaaaaacacggtatactgaacagccatcttgccaagattttagccgaccttggccacactgataaaattgtcatcgcggatgccggactgccggttcctgacggcgttttgaaaattgatctttcactgaagccgggccttccggctttccaagatacagcggcagtgctcgctgacgagatggtcatcgaaaaagtcattgctgcagctgaaataaaagcatccaatcaggagaatgcgaaatttctagaaaatcttttctctgaacaagagattgaatacctttctcacgaggagtttaagctgctgacaaaagaagcaaaggcagtcataagaacaggagaattcacaccatatgccaactgcatcctgcaggcaggtgtgcttttctagaaaggaggaggaaacatgcagattgaaatgaaagacattcataaagcattcggaaaaaaccaggtgctgtcaggcgtttcctttcagctcatgcctggcgaggttcacgcattaatgggagaaaacggcgccggcaagtccacgcttatgaacattttgacaggcctgcacaaagcagataaaggtcaaatcagcataaacggaaacgaaacgtatttttccaatccgaaagaagcggaacagcatggaatagcctttatccatcaggaattgaatatctggccggaaatgaccgttcttgagaatctatttatcggtaaggagatatcctccaagctgggcgtcttacaaacaagaaaaatgaaagcgctagcaaaagagcaatttgacaaactttccgtctctctttctcttgatcaagaagccggcgaatgttccgtcggacagcagcaaatgatcgaaatcgcaaaagcgcttatgacaaatgccgaggtaatcattatggatgaaccgaccgcagcgttgactgaacgtgaaatcagcaagctctttgaggtcattacagcgttaaaaaagaacggcgtctccattgtctatatttcgcaccgcatggaagaaatttttgcaatttgcgacagaattaccatcatgcgtgacggaaaaacggtagatacaacaaacatctcagaaactgattttgatgaagtcgtcaaaaaaatggtcggacgggagctgactgaacgatatccaaaacgcacgccttctctcggtgacaaagtattcgaggtgaaaaatgcctccgtaaaagggagttttgaggatgtcagcttttatgttcgttccggtgagatcgtcggtgtgtcaggattgatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggctcctgctcgacacctcgatccgcgaaaatattgccctgcccaatctgtccagcttctcaccaaagggtctcattgatcataagcgggaggctgaatttgtcaatctgttaatcaaacgactcactatcaaaacagcatcaccggaaacgcacgcacgccatttatcaggaggaaaccagcaaaaagtggtgatagccaagtggatcggcatcggaccgaaagtgcttatcttggatgagccaaccagaggtgtggatgttggcgccaaacgagagatttatacgctgatgaatgagctgaccgaacgcggcgtcgctatcatcatggtgtcatcagagctgcctgaaattctgggaatgagcgatcggattatcgttgtccatgaaggcagaatcagcggagaaatccatgcacgagaagcaacacaagagcgaattatgacacttgccacgggagggcggtaatatgaaaacggaacaactgcaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcggaatgacctttgtcattttgacaggcggcattgatctttctgtcggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacgcttttcagatgttcggacgcggttactttttaggcattcctgtaccggcgattacgatggttcttgcctttgtcatcctttgggtgcttcttcataaaacaccattcggacgccgaacgtacgctatcggcggcaacgaaaaagccgcgctcatttcaggcatcaaagtgacgcgcgtgaaagtgatgatctattctttagccggtcttttatccgctcttgcaggtgccatattgacttcccgcctgcattcggcccagccgactgcgggggaatcgtacgaacttgatgctatcgcggcagtcgtcttaggcggaacaagtctttctggcggccgaggacgcattgtcggcacgttaatcggggtactgatcatcggcacacttaataacggacttaatctgcttggcgtctcatcattttatcagctggttgtcaaagggattgttatcttgattgcggtattgttagaccgcaagaagtcagcttaggagggttttcacatgaaaaaggctgtatccgtcattttaacgttatcattatttttgttaaccgcctgttcgcttgagcctccccaatgggcaaagccgtcaaactcggggaacaaaaaggaattcaccattggcttgtccgtctcaacacttaataatcctttttttgtctcattaaaaaagggtatcgaaaaagaagctgaaaaaaggggaatgaaagtcatcattgttgatgcacaaaatgattcatcgaaacagacgagtgacgtggaagatttaattcagcaaggtgttgatgcattattaatcaacccgactgattcttcggcgatctcaacggcagtagaatctgcaaacgcagtcggtgtgcccgtcgtaacaatcgatcgatctgccgaacaaggaaaagttgaaaccctcgttgcttccgataatgtaaaaggcggtgaaatggccgcggcgtttattgccgacaaacttggaaaaggagcaaaggtggcagagcttgaaggcgtccccggcgcatctgccacacgggaacgcggctcaggattccataacatcgcagaccaaaagctccaagttgtcacaaaacaatcagctgactttgaccgcacgaaaggcctgactgtcatggaaaacctgctgcagggccatcctgatatccaagctgtttttgctcacaacgatgaaatggcgctcggtgctctcgaggcaattaacagctcggggaaagacatattggtgatcggttttgacggcaataaagacgcgctcgcttccattaaagacggaaagctgtcagcaaccgtcgctcagcagcctgagttaatcggtaaactggctacagaagcagcagatgatattttgcacggaaaaaaagtgcaaaaaacaatatccgcgcctctcaaactagaaacacaaaaataattgtctgatgtttaggaacctgcgataacgtgaatagagttatagaatgaattatttctcttacgtgaggagaggaacggcatgaacaaaccaacaaaactattttcaactttagcacttgcggctggaatgactgcggctgctgcagggggcgctggcacgatccatgcccaacagccagaaacaacggtaagcattgatgatttatacagttatccgattgattcttatttggtatcagcagaggctctaaatgtcagaacgaagccttccgcatcaagccagaaagccgatacgctgcacttaggagatagcctaaagctgatttccttctcaaatgctgactgggcaaaggttcattataaaaacggaaaaacaggctttgtctccactcattatattgtaaaagcagcaacaacagtaaaaaccaaaacaaaaacgaaagtatacacatccgctaacggaaagagcattaagactcttccagcagacacaagcgtttcttttttaggctggagtcaaacgaataaaggcggttttgattttgattgggtattcgttgattacggcggtgcgacaggttatatgaaaacaaaggatttacacatgacaaaataactgagagggattccgtatttatgcggaatcccttttattatgaattgatttgtcacattcccaagatatttctcaggaaatattgtcgtatgctgtgtcgaaaccttacatgatcatcgacatttttgttcacgctaaatagcggaggtgtaaatatggatcaatttgaagcagcatatgaatcgtataaagcccggcaaacaactgtcgatcaagaaaatgttccatctggaaaagaagaaattattgcggttagaagaaatgaggaagacaatattatcgcagtgaaaaccaatacaggaagagagctcgactatcctactgcgctgtcagaagcaaaatcaggaaaactcgctcatgttgatgtcttccataaatacgggcgtgacattttgcgaagtgaaccggacggcatcaaggaaaataacctgtctgagctgccggatttttaaacaaatacagccctgccgtatgttcgacagggctttcttttaaacaaaaggctgctgaatgtattcggttaaccgttttgcactgtgagaaatatcctctgcagctgcataattcacgccatagaacacatatggaggcagatacttcatgccgatcagattactcgtggcctgaaatggtttcaatagctcactgatcgagtaatgatttgctccgcccgcttgatatttttccgcttcgctccctgttgatacagccagcatcagctccttgccatgcaaggcatttccttctgaaccaaaagcccagccgtaagtcagcacaagatcctgccattttttcaagagcggcggagagctgtaccaatatagcgggaattgaaagacaatccgatcgtattcctcgcacagctgctgttccttcgcaacatctatttcttcatccgggtattccttataaagatcccgtactgtgatattgtcatgtttactcaattcctcagcccacgccttattaacaactgaggtctccatatgaggatgcactgccaaaaccaatattttcatcagaccacacctttactgttttgatgttattttaactaaaatcaggaaaagagccaaataaaaagaaagccctgctaaaaggggctttctttttttcttttattcaggacttccttcagttgtttcgatatctttcgcaaaatcagggttatccagattcgcattaaagaaatccgctgtgttcggaagtctgagattcatgttcattttttgagaaatcgtaaccgtgcaatcctcaagcacatagtcaaaaacgtgtccgcctgaattgcgtccttcgtcaatgaagtgcaggtgatagccagaaacggcgattccgtttgcataagctggtgtcaagaaacctacgatcgttcctctcacgttgtcgaagttgaaaatcggctgtgttttgaccgcttcaaccattggcacgtaaggtttttcttgaagttctaccgttcttgtctgcacctttttaaacaatccgtcaatgcgaattgcataaaataagtttctgcttggcagcatgctgttgatctctttttcaaagtcttcgcgtgtcattttcgcatcaattttgtgcgtcatgtccggtgtaaagaacgtaaatgaacagaacggagaacgatccccattttggaccggtgtcgcagttccgtctgaacggagacggtaaaattcgccgtcaaacccaatcagctctccgtcaagcttgttaaaggttccgataccgaagtctccatatttcggaatctctgacagttcaaaatctccgtcatatactccgtctaatagagaagtcattgttgatacttgataaatctggctcacaggctgatctttttgaccgcggttgagcacttgaatgttgctttctcgtttcatatttcccttcactccttttatttagtgctgttcataaaacagtgtcgtgatgcgcagagtgctagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaaccgctgtctctaattccattgccgagaataagaaaccgccgtcaccagagacagaaaccactttttctcccggtttcaccaatgaagcgccgattgcccaaggaagcgcaacaccgagtgtttgcataccgttactgatcattaatgttaacggctcgtagctacggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgacattccagaatttcggatcatattcaatcgggtcatagccgatcgtcagaacaacatctgcctgctctatcagtaaatcgccaggctggttgcggaacaaaccgatacggccaaaatactgatcctctaaatctctcgaaagggtaccggcagcttgatatgtttcaacaaatggaagctgaacctttttcaaaagcttgcgaaccgctttaatcgcttccggtcttccgcctttcataccgactaatacgacaggaagttttgctgtttggatttttgcaatggccgcactgattgcatcatctgctgcaggaccgagttttggcgctgcaacagctcgcacgtttttcgtatttgtgacttcattcacaacatcttgcggaaagctcacaaaagcggccccagcctgccctgctgacgctatcctaaatgcatttgtaacagcttccggtatatttttaacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccaccaagcaatcaacaacaagctccgcccctctgtttttcacaagggatttttgttcttttgttgcttttgtcaacaccctcactccttattatgcattttaaacgtaaaattttaaatatcttgtgataagtttcactatacactctttggaaattgacctccaatatcgattcgccttatgattaatatgtaatacgaattattaacctatggaaaggaatgcatattgaatggagcttcgccatcttcaatactttatcgcagtagccgaagagcttcatttcggaaaggctgcccggcggctgaacatgacgcagcctcctctcagccagcagatcaaacagctggaggaagaagtcggagttacgcttctgaaaaggacaaaacgatttgtcgagcttaccgcagcaggagaaatctttttaaatcattgccgcatggcattgatgcaaatcggacaaggaattgaactggcacagcggacggcccgcggcgagcaaggccttctcgtaatcggttttgtcggatcagctacatatgaatttctgccgccgattgtccgggaatatcgtaaaaaattcccatctgtgaaaatagaactgcgtgaaatatcctcgtctaggcagcaggaggagctactaaagggcaacattgatattggtatacttcatcctcccttacagcatacagctttacatatcgaaaccgcccaaagcagcccttgtgttttagctttgcctaagcaacacccattgacttctaaggaatcaattacgattgaggatttaagagatgaaccaattattactgttgctaaagaagcatggcctactctatacatggattttattcagttctgtgaacaagcgggcttcagacccaacattgtccaggaagccacagaatatcaaatggtgattggtttagtcagtgccggaattggtatgacatttgttccttcctcagccaaaaaattatttaatttggatgttacttatcgaaaaatggaccaaatacagcttaatgcagaatgggttatcgcttaccgcaaagacaatcataatccgcttataaagcattttattcatatttcaaattgtcagcagacaagaactaaagagagtgatgcaggtacatgaacgatacttgcaatctcttttttcttttgggattcttatggaatttttattaatttaatataatcgcttagtacaacttcatatcagtatacgtatacatacagtacaaatagttggcaaggacattagtaagcgcaggacattagtttgattttaaaaatgaaagatagagaggtgaagtaaattattgagttcaccggcatattcacattgctcgcttttttcgtaacaatgatttttattttctggagaccaaaaggactaaatgaagctatccccgccacatttggcgctttaatggttttattgtgcggaagtgtgtcattggcagacttaggggaaatcggaacaaaagtcacgggtgcatcggttacaatccttgccactatgattatggccattgcactagaaagctttggtttcttttattgggtggctgcaaaactgctccaacaatccaagggttcaggcatcaagcttttttggctaaccaatttgctctgctttctcatgaccattttcctgaataatgatgggagcattttgatcacaactccaatccttttgcttgtactaaaatatttaggtttaaaaaaacatcaaaaaaccccatatttattaagcggtgttttaatagccacagcctctagcgcaccgattggcgtaagtaatattgttaatttaatttctctcaaaatcattggaatggatctatatcttcacactgccatgatgtttgtccctagtatgatgggactcatttttatgacctgtctactgtttatgttcttttataaacgtcttcccaagagcctgccagatataccgagccattttcagtctctgcggcatagaaggtaccatcctcttcattcgccatcagctcctttaccagaacgaaatcaaacaaaaatcatgttgtttgtgcttgcatttgtttttctcgtcagaatgagtctatttgcagcatcatataccggtatttctgttcctctagtcgctgtcatcggatcttttatcctgttgagctggagatggatttatttcaaaacctccccaaaagacttgttatataaatcgccttggcacatttttatattcgcttttactatgtatgtcttaatttatggtctgcataatattggattcacagagttacttgtgaattattttgaacctgtggtttctggaagcctcgcccatgcaactttcgcatcaggtatctctacttcagttttttctaatctctttaacaaccatccagcgttaatgatcagtacttttaccttaactgaaatgaccctgaatccttcaacaacaaaaatcatctacttggcaaatattatcggcagtgatatcggttcattattattacctatgggaaccttagcaacgcttatttggatgcatatattaaaacagcatgatgaaagtatttcatggggcgaatatataaaaacgaccattatcatcattccgctgactgttctttttacgttaacatgtttatatttttggatcagttggttatttctttagttcagtatgaaacgaaaaactgccttctgctattcaagagggcagttttgtatacactagggaagatgcattgtctttagatgatttaacttccaaatgactggctctccacttgcgttaataagctcaatgatattattagagacaccctttaatagtccgactttttctggcacctctcccatatcaaatatgaccaattcaccaatattttttttgatctgctcctcaaaattacgcacaagaggaactttggaaggcacgaccggcaattgtgagttgtcaagagtatacggtgtttgttcagttgaataaggggtaaaccattttaaatgatgcatagatataaaaagtattttaaatacgggtgagaaaaatacaatataatcgtttaaaacatttgtaacatacccatggatcgatcgacccccagttacataaacttcaataaactggcctttgaccttgtttaatgtatttctatatgaaaaagctagagtttctgcctctatcattggatcttccggattgatcaaaaatggcttctcagtactggtcattattttcgccttgtttatttgatgaagatgcaacaagggaatataaagataattgcagccatcaaaaataacaaaaatatcctgtccgatatctatgagggtgccgacaaaccttgtatctcctgaaatgacaacctcaacatctgtgttaaggaattgattcaaacctttcacgattctcctcctttaactgaaaaagggcatcacttaatctgatgctcctccattatctattaatatttacgtttccagtgatagtctatcgttctgacaatcgtttcatagctataatcttccttttgttttcctgaactttttattgaacttgaataacctggtgatcttgatgattgataatctgatgatcttggtgatcgtttagatgtttttgatgaactctttgcacctgatgaactgtatgattttgatgattgataatctgatgatcttggcgatcgtttagatgattttgatgaactctttgaacctgatgagctgtatgatgttgatgatcgatgatctgaagattttgatgatcgtttagatgattttgatgaactctttgaacctgatgagctgtatgattttgatgactgataatctgaagattttagtgatcgtttagatgattttgatgaacttgatgagctatatggctttgaagaaattaacgaactgctgtacacttcttctttttgatctgtatcatcgctgtcttcctgattttgatgctcattcttttcatcctcttttttgtacgacccttttgggcctaagctgatgctttttatgtgaaaaggatagatgcgaagcacctcttgatttttcactatagtataatggccgtcggcattatctacaaggataccctcaatggcttccggacctccacgattaattgaaacccatttatgagtcagactcttaaaaacctcgcttaaataatcagcttccaagacacctgatggcgtctgtccttctattttcaaatcgggctcatgtttacttatactctttatgtgatggatattaaaatacactaccccatcctcatttgtgtttaacgcagcgtaatcatctcccagccagaccaatcttccttttttagattccggacccccttgattaaattgaactgattggttcattaattgtccgattaagctatgaaaatcgtcagcgtcgggcatttcctcagtctcaattgttgtggtgctattattggtatcctcagtaatacttttcacatgctccaactgataataaattatttttttttcagcttgtaaagcaatataatctgattttacagcagctaattttccttttttagattccggacctccacgatatacagtaacaattttatctttcattgaatgcaaaaagttataataagatatttcatcatttgaatgatacttcattcttctcttgctcattcaagttcctcctagtcacttatacatagatgataaacatattgcatatatacgtgtcacgtttatttgttgaactaattcaatagcctaattgtcgctttttcagcagaatacctattttcacacattcataaaatacttaaattatttttaaggtattgtgaacggtttttaatatactcacaaatcacatccggctcacggtcaaaacgctcaacatcattctttttatatgggtccattaagataaaaggcctaatccgctcatacatcgccattattttcggttccatatattctatcgtaaaaagagattggagcgttttttctaacaggcgcttgtaggacttgcgaaactcggattcatccaatatccgggcggttagtgtattaaatccttgaattcttacataatcggcagccatccgctctccatggatatccctgccccaggtcgcatcataatcccaaggaatcacctcaaataatccggtttccccgcttctgtataatgcgtagttgtggacaaatccatcatagttcgaggtgaatacaataccggcaagccagcgcaaatacttatcgacatccacatgttttgtcacttctgacttaaactgagctttagggacagtattaattttaaaaatcatatcctgtaaataaaaatcatcttccacagtccctgtcttcttttcatatccaagctccagcgacgtcttcgtttccttttccaaatcgctcatcagagaaaagttagcatcatcatccaccgcgtaaaaaatcgcgccatcagccagcttccttttcgccaaataatattcatctacggattcaagttcaagataaaccccttcattcttcccattcacctttacaaacacaaactctgcctttggagacagtgtccctagctccgagaaaaaatccagagacaatttgtttctcatcaaggaagggtctttatactccgcatttaagtgaatctctcgcgcgccgcggaatgttttcggctgataaaaggaaatatggtatgacttctttttgaagtctctgatatgtgatccccgataagcgatatcgatatccagccttttttgatttaccttcatcacagctggcaccggatcatcgtcccatatatccttttttaattcacgcaaatcttttggatgaacaaacagctgataaagcggtaaattggattgattcttcatccataatcccccttacaaattttaggcttttatttttataagatctcagcggaacacttatacactttttaaaaccgcgcgtactatgagggtagtaaggatcttcatccttaacatcatttttaaaaggaggatttcaaattgggccactattcccattctgacatcaaagaagcggtgaaatccgcaaaaaaagaaggtttaaaggattatttataccaagagccccatggaaaaaaacgcagtcataaaaagtcgcaccgcactcacaaaaaatctcgcagccataaaaaatcatactgctctcacaaaaaatctcgcagccacaaaaaatcattctgttctcacaaaaaatctcgcagccacaaaaaatcatactgctctcacaagaaatctcgcagccacaaaaaatcgtaccgttctcacaaaaaatctcgcagctataaaaaatcttgccgttcttacaaaaaatctcgcagctataaaaaatcttgccgttcttacaaaaaatctcgcagctacaaaaagtcatactgttctcacaagaaaaaatctcgcagctataaaaagtcatgccgcacacacaaaaaatcttatcgttcccataagaaatactacaaaaaaccgcaccaccactgcgacgactacaaaagacacgatgattatgacagcaaaaaagaatactggaaagacggcaattgctgggtagtcaaaaagaaatacaaataatctaagttttcattgtttcaataggctgccggcggaggtacggaagcctatttttttatttgccctgtattagatatatgtcatgacataacatatgcaacccgcatcatttggtttcctttaaaccatttcgttataatcaaggtatcctaacgataaaggcggttgttgctatgtacatatttcaagctgatcagcttagtgccaaagacacatacaagctattgtcaggtaccgttattccccgccccattgcatttgtgacaacactttcttcaggaggagcggtcaatgccgcgcctttcagtttttataacgtcgtcagctcagatcctccgcttctcagtatttctgttaacaggacggaaggacgccaaaaagatacagcgcgaaacgcagtggagaacggagaatttgtcgttcatgtcagtgatgaagccatcattgaagatatcaatgaaacagctgcaagcttaaggccggatgaaagcgagcttacacgcacctcgcttcatcctgttgaaagcaaagctgtttcagttcccggcattaaggaagcccgcgttcgctttgagtgcaaattagagcggcatattacctttgacaatgatcaaggcgtcactacagcagatctgctcatcggaagggttgtctgcttccacctagatgaaaaggtgtatgatgcagaaaagggatatattttaacgtatgaattaaagcctgcctcacgattggcgggaaatcactatgccaaactcggggaagaattcacactgattcgtcccagctgaagagaaggactacttaaatagaagaaactagtcaaaaagaccttatgattacataaataacgcctgtaaaaaactgaaaaagtatcaaaaaaaagaacacccagagtaagctcgggtgttcttttatgaaacgtttttcctttttcttcgtataaaggtagatgaggaggaattggaatgacaaacttttggattttaatgctgatcgctattaccatcagtctcgcctctcaattttttataaagaaaaaatacggtattgataaatccggctggcgatataagcatgtcagcaatacacacaaatggatcgaaatcactttacttattttgtttgtggtttcactctccttttttccagttgaatatttgcttcttttattttttattgtgattgactcaatacgaatttttatggagtggcattatagacctgaagataaacagtatatgtaccacattgtagaggtctcccttatgtttatgcttttgatttatatttgtaccctatagttatttatatccccacagccgctccgtctccccgaggatcggctccgccttggagaaagccttcttcatcaactttgattgcagccgcttgtcccatcagcggatcatagtcaccgacaacctccacgagatgcccgctgtctttcagtttttggattgttttgtctgtgaatctgccctcgactctgagaccttcgtattcctctccccacgttctgccccatacccagcgcggttcgctgattgcctgctgtggatgcattccgtagtccagcattcgggtaatgatggccgtctgggtctgcggctggccttcgccgccttgtgtgccgtacagaatttttggctttccgcctttacagaccatagccggcatcaacgtatggaaggtgcgctttctcggttcaagcgtgttgacatgattttcatccagtgagaaaaatgatccgcggttttgcagtaatatgcctgtatcaccggcagtgactgccgagccaaattcaaagtacaggctttgaatgaatgacactgcgttgccatccgcatcgattacggccgcatatgccgtatcacttcccaccggcctgctttctgccggtattgcgagatagccgatttcttctgccaattgttttgcataacgtttgtccaaaagcctttcaagcggaatgtctgcaaacgccggatcagtcaggacggcatcccgatctagaaaactctttttcaatgcctccacaagcacgtgataatactcaaatgaaccgtgttcgatttgggtgaaatcatagttttccaaaatgttcagtgttaataaaccggtaaatccctgagaattcggcggcgcctgatacacactgtatcctcgataatcacttgatacaggcactgcccactcaccccgatgcgctttaaaatcatcgattgtcatgtaactgccgttattctgtaaatgtgagacaatccgctgagcgagatctccttcataaaatgcgcttcttcctttttcagcaatcaagttcagactgtctgcaagctctttttgcacaaaccgctctcccgggacaggtgctttgccccttctcgtgaagatgtcagccgtgtaaggcgtggaagccagcaattcaatattcttttctgtgtgacgacactgatctgctgatacaggaaacccattttgggcataatcgcgtgcgggctccaatacatctgcaagagacagacgcccgtactcctttaggaccgcatcccagctatcaaccattcccggcacggtaatggcactgtcaattccccgcagcggaatcgcgctttttcccttatatacatctctcgttacgttttttcctgaacggccgctgccattgtagacttttactgcctttgtttcctggtgaaaggtcagccaaaaggaatccccgccaagtccggtcatatgcgggtacacaaccgcaagacaagcactcaccgcaacagcggcgtcaaacgcgttgcctcccttatccagtatgcggtttccggcttgagaagcgaggtaatgcggactgacgaccatttgctttgtaccgatgacagatttgttcatcacaagtccccttttttaagaaattttcttcagtatagggagcctgatttttcacatctactgatccggcagaaaaactgacgaactttcttcttttcgcaaataataagatattttttcgttcatttcgaaaacaaatgaaaaattatcatttcgatacgtaacttttatgataaaatgattgctaaaaggcaacgaaagcaggtggagcaattgagtcatgaatatcaaatccccaaccttgtacttgatgagactgataaacaaattctcacgattttgcatgaagaaggcagaatttcttatacggatcttggcaaaagagtcgatttgtcacgggtcgccgtgcaggcccgtatcaaccaattaattgaagccggtgttattgaaaaattcaccgctgtcatcaatcccgctaaaatcggcattcatgtttccgtgtttttcaatgtcgaggtagaaccgcaatttttagaagaggtcgctcttaagcttgaggaagagcctgcggtcaccagcctttatcacatgacaggcccgagcaagctgcatatgcatgggatctttgccaacgatcaagaaatggaagaatttttaacaaaacggctgtatccattgcgaggcgtcgtcagtgttgattgccagatgctgatcaaacgatacaaaagccgtatgggaatgaagctgtaaaggagagaaacgaatgaaaaaccatccttatcgggatatgacggtcgcaatggttcgcaccggcatattagggttcggcggcggaccttccgtgattccgctgatccgccatgaagcggtcaataaatataaatggattgacgatgatgaattcggagaaatattagcaatcgctaatgcgcttcccggaccgattgccaccaaaatggctgcttatctgggctttaagctaaaaggcacattaggtgcaattgtggcgaccctcgcccacattctgcctacatgtcttgcgatggtgggcttgtttgcggctgtaaatgtgttaagccattcagcaattgttgcaggtatgattggtgccgtcacgccggtaattgcggtcatgctcggaatcatggcgtacgagtttggccaaaaagcgcttaaaggtttcggctgggtcaccggcatcctgttttttatcatcgcttttatcggcctgcaaactttacagattaatcccggccttgtcattatcattttcttagcgtacggggcgtttcattttaaactgaaagacaaaatcacaaataaacattcaaaagataaaggaatgtcagcctcatgatatcgatctatttatttatggcgttttttatcgcaaacctactgggatatggcggcggacctgcgtctatcccgctaatgtttgaagaagtcgtaaacagatacagctggctctcaaacgatcaattctcaaatatgctcgcacttgcgaacgcattgccgggcccgatcgccacgaaaatcgctgcgtatgtcggctacagcgcaggcgggtggcccggcttcctaattgccctgatcgcaaccgtcgtaccgtcggcgctcgcattgatcgtcctgctgcgcatcatccagcgcttccgccaatcacctgtcatcaaaggcatgacgctgtccgtccagcctgtcatcgcggtcatgatgctcattcttacctggcaaatcggcgcagacggcatcaaagcgatcggctgggtccaatcgatcgtgattgcgggaatttcgctccttgccatgacaaaattcaaaatgcatccggcatttttgattattgcggcgtttttatatgggggccttgtgatccctcatttatagaaaaaagcacctggacaggtgcttttttattttggcccagaaatgccgtttgatatgacagctgtttcttctcctgcgtcactcttgatgatgtgcttgacttgcagcgtggttcctgccattctcacatattgcttcaactcggacgaattggtttcaacttgtatccaaacaggaggctggaccttccaaaataaaaagaatgcaagaatcagcatgccagcaatgaccgacagcaaaaacttcatatcgcatcgcttcttttcagtaagcggctcgcagcggacagcgcctgatgatcacgaagaatatcgcctggacgattgccttctcccagcacataacctttaaagggcattcccataaaatgaaaaatatgttcgaattgctgaatcagcggcagcccttttatttttggattgtctccgcccactgctgttacatatgcctgtttcgctgacatttgctgtttaaaatcaggaaatctcggatctctcaacgtctgtgaccagcgatcaataaacagctttaatttccctgacatgccaaaccaataaattggggtggcgaatacaagaatatggcactgcaatatccgttcaatgatagaatcgtagtcatcttgaacaggacgaaagccgccttgggcgtgacgcagatcttcaattggctggattcgatatttccgcaaatgaatgtgctctgtatcgaatccttgaacagccttctccgcaagaatatccgtatttccgccagaccgagttccgccgttaataaccgcaattttcatgatgcatctgctcctttgtttacgaatgattttcttcatcttataatggattcatcaatcaatacagatgattatttcgattaatccaatcgctaaaaccgatttagaaaggaagagaacaagtggaattgaagcagctgatcacctttattacggcggcagaacatgtaaacttcaccctaaccgccaaaatgcttaattatgcacaatcaagcgttacctctcagatcaaatcacttgaagaagaaattgggacgcctttatttgaacggctcggcaagcggcttatcttgacagaagcaggaaaaacgttcaaatcttatgcacagaagatcattgcgttaacagaagaagcgaaaatggccgcaaatcaagtaagagaaacaaccggaaccttaaaaatcggggcgacagaaagccagtgcacataccgcctgccccctatcataaaagaatttaaacaggcttttccccaagtaaagctcatattcaaaccatatatctccaatgaacaagcgaaagaacagctcttacagggccagcttgatatcaccttcatcttggatgtaaaccggatggaagacgcactgcacgttgaatctttgattcaggatgagatcaaaatggtggctgctaatgaccatccttttcctgcggatttaccaataacattgaaggatcttcaaaacgaaactcttctgctgacagaggacggctgctcgtaccgcacgctctttgagaacaatttgcatgactccggtgtctatcctaacaaattggaattcgtcagcatagaagccatcaaacaatgcgtgatggccggacttgggattggaatcttgcctgaaatgacagtaaaagatgatattgcagcaggccggatgaaagaactcaattggcagagcgattgccccgttttcactcaattagcatggcataaggacaagtggatgtctgcgccattaaaggcttttatcgatttgacacggaaaacattcaaataaacctctccacaaggacgacatggtttttgagaccagaaaagcacacacatacaaaaaaacacttgatgacttagagccccaagtgttacacgtgatttttctgataaaacattcgcaaaacatgagtttcaaggtcagccaggcggacagggatcggcagtctgctttcttgattaagcaggctcaacgtaatttgataactgctttctaaatcaatgttatttccgcaagacaagaaaataggcttcacatcccgccgcgttcgcagcgcccgtccatatacctcgccgtcaatgataatatcggtgtatgcgcctacttcattttcaggcgtcacgaaatcatagcctttgattttgagataggttttcgcaatcccaatcgtcggcttacccagaaaaaaagccgcatgggtggcaacgcccatatggttgtaatgcaaatatccgttgccatcaaacaagaagacatccggctccgtctccagctttttcgccgcctcgatgatcaaaggcagctcacgaaacgcaagaaaaccggaaacatacggcacgctgattctccccatgctgtgcactttttcaatgacttcttttgtatcagcgtcaatcacgataatacagcacaccccatacggttctccatcctgctcccaataggccaggtcaacgcctgcgcaggtgttgatggagttgggatggatcgtgtgggataggttgatacgatttctaagggattgttgtgtttgaacaaaatccgattcatcttttagatgaaaatcgtgaatttgatgtatttccattttacttgtttccctctcttcgcgctcaattgtcctgcatgtcgaatctagcaatgacaccaaattatatcattgaaaaaagcagatagtataatctgcttttttattaatattcatttttcatttctttcataaaaatataatccaattgtttaattaattctttaagttcagtacacataatatcctctaaaggattttcccaatcttcgttttttatcagttcaatcccatagcttccggctggatcaccttctgggtaccaccctacgtcaagcagcaaattttttgtcttatgagaaatctgcaggagatcttgattaaagtcaaataaccaagcatcatcatttgcctctagcgtcttaggatcagtatcttttaatgtaatataatcaacagtccaaccagccggtatctttagccttaaaaaattgggaatctgttggcttagtggctgcaaaccctctaaaaccccgcttcccacactccagatttgatattctaactcttctaataattgttctatctcattaaaagactcatcttcataaatcttatctgtttttaagccagctactttgatatggtattgattattttcatatactgccttcataacagcattacgtttttcattttgtagttttagtagttcacatttttcttgcattcttttttctgaacataaattgttcagtactacagaccagccattacagatttttaatggctgcagttgagaaatatggtctctttccatcccgcttctccttcattattctaaaaaatctgccgattgacaacccagaaagaagtttaaactattctaatatatcagtaaacaaggcacttctaacgttaacctcctattgaaagctgtatacaatgagaaacaaaaacgccagcccttggtgtccatagactgacgtttcttgaaaacctctcttaaccttttttaaaaacgataaaattcccgttaggataatcgccattccaaccacacgggaaataacccgctttataaatttcaaaaaccttttcaaaaaaattatttgtattaccattaattgctctattaatagcacaattgtttaggtcagctactatatcctcaaaaaaagtcttgaattcagtagaagcatgtctgatgctctcagaaaaaatatctaataatgcgtctatattttccggcttttgattatcttctaattcgtaaaaccgctcccatacttcactcatttcaatttctcttatatctttccatgtatactcatcttctccatatacttcttcataagccaagtattcagccttttcttggtcattaattatttgagtaaaattagatacattaactgaatttataggcttgaaggtttttgaaaattcaactacctcttccaccagattatgatattttccaaaattcattacttgttataccacctttcccaaagatcaactgttgctccaccgcctcttttccaaacgggttttcttgaggcgttatcttctctcctttctaatttatatgcttctaatcctttctcctttattttctttaattctgtttctaaataatcatccctcatataaagaggcaaccctttttcttgtaattctcttaatttttgttgtaaatcatatacctgtttttcaatgacgtctacactttggttaacattaatctcatctaatttttttctcacaaaactactataaactgaatgatatcccttatgccgtgaagtagcacttatatcatcatccgggacccttaagaaaaagccatttgacgcatcatccatatccattcctaacttcttcaaaacaggatgacttcgaaactccttcgggataatatgttgagcctgatatggagtacgttttgttgaacgtggaagtcccatttgctcaaacatatttttacctaatttagttgaactcccccctgtaacctttcctggggtccctggaattaatcttgtggtagtgcttccactgctaccactactcgccatcttcacaatcccaagatctttcacagctttcgtttccacatcagcgtgaacaattgggaaagttgtcccatccggtgtgacagtcttgtggacacgaatttttacattcgtcggcactttgaattcttttacttgatctagaatctttctccctttttcaacttttgctacttgtggcgatttagcaagcgggatgcctttatcaatatgtttcgccaatgcaccggctccaaccaagctcaatgccgcttcgagcgccccttgcttccgcttctcctcagacactttgtttccaaacatatcccgtcccgtgacggcttctgagaatccgtttgacgcaacaaggccgtatgcgcccatttctgtcattttgagaatgtctaaggatttgcctgttttgtaggcatctaaagcgtgttcagctgcgatagcagcttttccggttttgtagatggcttttccgcctttgaaggcgcggcctgcccagccgacgactggtataaatccggctgcggccatagctcctgctgtcacacgttctgcggtggagagtttttctccggtaaccgggtcaacgccttcagttgctcttttataatcataatagccagtgacttctccagtaaagttgcaaactccatcccatgttttttcgtaccacggtttgtttgcttcttcctcggctttttcctggagccgtcttgcttctgcttgctgggtttttgcatcgatataggttgttccttgattttctacttcaatgacgcttttgtagacttcattgctgtggaaggcttttttgtcatagtacataggggatgcgctcttcccattgctggtggcctgcatgagaacagaatatttggtgagcactgcgttgtccagagattctaaattttgatattcagtggtcagggattcatcaagcttatcgacagctgtgatcgtgtcacgtctgattttttgggcatcgcccatcttatctgcatagtcgtcaagcgtatacatgtcgagatcaataatatcgctgatgcctgacaaaatagaatcgatttcttctttatgagcggagactatctctgaggctttcaggtctccattgggcagctcatgatccaaaaaagaagtttccacatatgaatcattcagttcttgatctttaatatctcctgaaatgccatttaaaaacgcaatttgagcagagacaagcgtcagccagctgtctacgatttccgcctgcccctgaaaaaaatctttaatattatccgcgcctttgcctttaaaattatcgcctaaatctgcaactccctgaaacgcttttttcagcgtattcagctgctcctcaagcgtctcatattgcttttttctgctcttcgcttcttcgattaaagatttagattcaaatactttgctcatcgcactgccctttctgttctattttaccgctatcgcctcgtcctgctctttgagtgaatctacattatcctttgtatcctcgatatttttctgtaccgcttttttgtaatctccgagcatggttttgatgttctcctcacgctcatgatattttttcgtataatcgagtttattttttccattggaccccgcggcgccgattgatacgtcagcaagcgcatctttgacagaatctaatgttttgattacagtatcgtatttcaatttaatttctgacataaaaaagatcaccacaatttaatagatttaatttgattaacagcatcctccaagaattcttcacccttagcaagagtatgaccagcaaaattcgctagctttaattctttgtcatagagaaatttcatagattccaactgaataatctccatctgaatcgaagccatatactggttatatttatcattcacaatcttagatgcttccgatttcgcctcttctcttcccttgtcgaaatcatcggcttttgttcccgtccaatgcttgcccaattccggtttcacaatttctttgatttcagtgattgcctcttcttgcagtgtgtctatgtccttttttgcttttttcagcttttcgatcttgtcttccacgtcggaaatttttccgttgagcgaacttttgatatccgccagcatactttcataacccatctgaatcacctcttaatactcaaaaagtcgtatggaggggctgatgaagatagacttttccatactttatttccatatattatattttaaaatagccagaaggcggcttaaatagggtaaatggcttaatttaggcatataacgctcttgaaatgtaggtatttgatcttgtttttgttcgttatacagttaataaaagcgttttatcaaatagaaatacctaatgtcatagttataaaggcacttgaaagaggcagattttgttggcctgcctcttaccgtgctgagcttattgttcatcaggtcgatcacgtctgattttgtctttggcttctattattccccgcttctgaccctttggatcaaaagcttgtattagctgcagtcccagttgtacagaacgtttgaaaagtcttttttccttagatcttcaggtgtgatgaaaaaattggcgatgccgacgtctccccacattgaatcgatatcatcgtctgaatcaatttgtaaaagcatgatggtgtgttctttatatgcgtattcccgcggatcatgctgggtaaaagaagcgtatccgccgattttatggccaaatccgttttcagccagttcattataaatgtcttcttcatcctcgccgaactgaccaaagaactccattgtttccatgcccgtatactgctcaaattgaaaatctgtaggcagcacccattccgaagatttcacaggctcgactgccgcttctgataaaatcggaaaatcacattcgccagtgccaataaatgaaaaatcagaaacaagctcgtcttcgttttctatgatattttcaaaatagatcactctgaaattcttttgttcacatcgatcgtcaaaattcaatccatagacgtcatcatgaacagaaatgtagaactgcaggatacctgaagaagggtagccgtcaagctggggaatgtgtgagaaattaatctgtgccagaagcttcatcggctgtccattttcatcagtcgggtatgtttcatgcttggagaaatagggatcaccggcaattttgctgtcatatcgtcctgttttcccttttctcacattcagtttcacgtattctttcgctgatttctccagcaagtcgcggtacggtctcattttttcgggcagatgattcatcagattctctcctttccggcatctccaaggttttattttctggttttcttcgtttcttctaatgtttttcaaacgattgtttaaagaagccctacttctgcataattttccaaacaatagttaaatagtagcaaatgtattcagcaccccgcaatagaggaaaaaaaaagactggtgcgcaaccagcctttctttttcctctattgaattgcacctgacggaacaaccgccttccgaccgacagaataatactccactcctgaagccgcagcttcatccaatgtgtagcagtttctgccgtcaaatatgagcggcgattccatcaaatcccgataagccgctaacggaaattgtttaatgtcagcccagtcggttaaaatcatgacggcgtcagaacctttgacagcttcctcgatcgtctctttatattcaacagcttgcgggagaacatgctttgcatgaccaactgcaatgggatcgtaggctctgatacgggcgtcgagcgcagcgagacggtctgcaataacaattgacggcgcttctctcatatcgtccgtattcggtttaaatgacaggcctaaaagggcaatcgtttttcccgtcaccccgccgagcctgttcagcgctttatcaaccagcatcgcctgctgattgttgttgactttgataaccgatttcagcagttcaaaatcatgctcgacattgccggcaatttgcacgagggcgtttgtgtcctttggaaaacaagagccgccgtagcctatgcccgcttttaaaaactggctcccgatccgcttatcctgtcccatcccgtacgcgactgcttcaatatcggcgccgaccttttcacatatattcgaaatttcgtttataaaactgatcttagtggccagaaaagcatttgaggcatatttgatcatctcggcacttctgatatccgtttggtaaatcgggatttgaaacggacggaagagctcctccagcgtatttgctgttttctcatcggccgtcccgatcacgatcctgtcaccatgaaaggtatcatagatcgccgacccctcacgcaaaaattccggattggatgcgaccgaaatactgacaggctccgctagatgttcagtgatcagtccattaatcaaatcgtttgtcccaacgggcactgtgcttttcgttaccacgactatatctcgtttgacatgctttgcgatgcgtttggccgcatctgtaatttgctccagattggcgtgcccgtcgcttttctgcggtgtgccgaccgctataaaaatgatgtctgcctgtgccaagcctttctcatagctcgtttcaaagttcagccgtccatcagctgtattttttctcatcagctcttcaagacctggttcaaatatgggggaaatgccctttctcatttcatcaatcttgtgagcgtcaatatcaatgcaggttacatgatgtccaatctcagaaagagaaacacctgtcacaagaccgacatagcctgttccgatgactgttatattcattgtttccctccaacagttaaattgctgctttgcagcttccgtaatatcgtatgagaacatcctatcatgaatgcgaatgatctcccgcatagcctgtcgggtacatcctgtacagatttctgaaatgtgattcaaccatacaatacactattatatcgctctcaaaaagaaagtggtgaaatgagaatcggctgttaaaaaagaccaaacaattttcttcttttgaccggttgcggaggctgtctgaagatggtctgattccgcaggagaagctctgcattttccgtcagcatataaggaagttccgagccgaattctttctcaagaacataaagggcctcttgagtgtgaaaatttctcgttttcacattatgggcatctgaggctacgaaatggatcaaattggcttcaaccagccgaagagaaaatgctttcagctgcttgccgaaggtccccgcaagacttcctgaagtaatctgagatgctgctcctttttctacaagatgatacagcaaggacgggttttcgcgaatttccctgttgcgttcaggatgggcgataaccggaatatatcctttcagctgcaaatcataaaaaagctgctccgcatatcggggaacgtgatcaaacggaaactcaatcaagatgtgttttgtatcattcagtgaaagcagctgctgtttggcaaggtcttgttccacctcgccggagattctgatttcctgtcccggaagcacatgtaaaggaatgtcttctttgattaaacgtttgtttaactgatctgctgcttctctgactgcggctggctcgtttttatacacaccgttgttatgatgaggtgtcgcaatgatcgtccggattccctgacgaacagctgctcttgccatttctatgctgtcggccgaatcacctgccccgtcatccattgcgggaagaatgtgacagtgaatatcgatcatgtcctagcccccttttttcgcaaaaataaataacgggcacgatgcacgttatttatttttgcatgaaattgtccttgtttccgtaatatccgtattcagagtgcttcgaaagctttttgccgttcataatcgccccaaggagcttgcttttgcacgtttcaagcgcctctttcgcttttgcggcttgttctttttctgttttcccgcttgaaataaccagaacagaaccgtctgccacgttgcctaaaatctgtgcatctgctacggcaagaataggcggcgtatcaaaaatgaccatatcatatgccgcacacgcttcgtctgcaagctccttcatccacttcgaggagagaagctcggccgggtttggcgggatcgggccgctcgtcagcacgtcaagatgtttttcattcgatgcttgtacagcctgctccatagagcttttctttaataaaacagatgttaagccaaccgtattttcaagaaaaaaagccgtatgtactgttggttttcgcaaatcagcatcaatcaggagcactttttttccctgttgggcgaatacgacagccaggttggcggccgttgttgattttccttcccccggacaagccgatgtaatcatgactgatttcatttgccggtccactgaagcaaattctatattcgtgcgaatcgtccgatattgttcagagttcaaggatttcggctctgtcattgcaatgacatttctccgcatccgcgagcctctgttttttctaagcgccaaaatgtccactccccgttttttcagattggaaaccctgtaaggtctttgctgttttctgctcattcgcaatggtggaaactgtccctaaaacaggtatgtccagcaaggattcgagctgctcttccgatttgatcgtattatccaaatgctcaagcaggaaggccagtccgatgcttcccgccaatccggccgcaaacgcgatggcaatgtttagtagcggctttggcgatacaggggacggatgttctgaaacctcggcttttgacagaatgctgacattgtcaacattcataatggatgtgattttgtcttgaaaaacagatgctatagtattggcaatatgagccgctgtttccgcgttttcatccctgactgatatgttgaccacttgggagtcctgttcgctggatacggtaattttgtcattcagttcttgggatgtcatcgacaggcccatttctttaatgacttcatctaagatggcagggcttttaatgatgacattgtacgtattgattaactgaagattggtttggacatcgttaaattgaacttcttttcgttcatttttcgattggttgaccagaatctgagttgaattttcatagatgggtgtaagtgcgaagaaactaatgagtccgccggcagcagtggcagctgcggttacaatcataatcaaaagtatgcgttttgttaacgttgataatatctcttttaagctagtagattctcccatgatacctccaaatctcttataacatccttttccatttacgattatacaacgttgaaaccgcatttctccagcttttcacgtgacataattcgacatttttttacaaaacgatatgttactcttttttatgtaagcgctatatttactgtgttgacagtgctgtctcattttctcttattcgtgcagtcacgtaatctcgcataaaaaaatcccgctaaaggcgtgcgggatttttatgttgcatatccatttttaatatgagaaatcaaattttcaagcatttccttcgtcgtcatctcagatgactgctcaccaatttcatgtgcatgcatcaaaattttcagaaattcttcttgattcaatttcttttcactcatcttttttttcctttcagcttccattaagttgaaaacacgattattatatgatgctggttatcaatttgcaatctctaatacatcattcgacacatcccattttttatgtccttttttaggaaaaactttttaaggccgatgtgttgcgatataatagagaaattggatctttttattacgtgactcggttaggagcgataatcatgcttcagaatatgatttccaaagacgatgtgctggcatctgctgaacagttaaaagaacttcttccttacaatgaggaaaatgttcagctgatcaaaaaagcccttattttatatcggcaggattcagtctatcgtttacaagcagtgagtccgacggaagttacagcttacgtgcaggatgttgtgcctgtgcgggtcacattgaacttgtttgtcatagtcaaaagcggctgttcatgtccgtccggaagaatctgccgccatatgttggctgtgtttttatatgtatatgcaatgttcgagcgagtgggtacttttacagagtattggctggagagggaaaagcttgaggaaagcaaagagctcgtccgccgccagtttcaggaaaaggtgctgcctaatgaagaatcgctttcaagctggcttgctttttttgattcagagttttctctctggcaggcacgtacgccagaaggcagccaaaacatgcagggcctctattacggctacctgtccgcattaaaaaaacatgcgccgaacaaaccggagctgaaaagcctgtatcagattcattccgcgattgcggtttggcttcgcatgttcacattgattgaagcgggcaagctgaaccccgaacaagatttttattccctcaatccgtacgttgaacagctgatggatacaatctacagctctattgataaattaaaaacatacgcgctgtcttttgcgcttgatccgtttttggataaaacaccggatgttatccgacatttgctgttgagagaagaaattttccaatatgaacgcatccgcgtcttcggtgaaatttggagtgcgctgctttcgcgtccaaaatgggtgacacgcgaacaggagatgttgaaaaaagaagcaggacggcgtttttctcccgaattgcaattcgggcgcctgcatttggaattcctgcaaaagaatgatgacgttatttttgcggaagcggatcaattcccgccggaagcgctcccttatacgttccaatggctgagtgaaatgactgccaagaaggactggaaacggcttaaaacatggtaccagcaaattgagccaattgcgatgggttatacgaagctggataagccgtttaaagagattcgcgatgtgatcggcgagttgttccttctgttgaatgcctatgtgcagcaaaccaatgatcaagcgctgtttgagcgctttgccgcgggctgtctgccgtatacgttcacagaatacagccatcatttatatgaaaaaaaacgctatgccgagtggattgaaattcatagccttgtcggcttttccatcaatgaaatggataaaatgatgctcaaggaaattgcagcgagcgaccctgaggcgcttataccggcttaccatagagaagtggcttttttcattgatcagaagaaccgcagctcgtacaaggaagccgcccggtatttgaaaaaattgcgcaccctgtacaaaaaagcgaaaaagcagaaggtgtgggagcggtatattcagctgctgagctcgcattacaagcgcctgcgtgcgcttcaagaagaactgcagaaaggaaagttgattgatggcgagtcttaaagaaattctcatccacgtcgaacaaatggaagatgggtcatttacgctctcagcctttgatgaaaatgagcagcctcttccctacagccatatgaaaaagcatttgttccaatggcatgaatcctcattttacggaacctttctagaggatgtcagcttcatcgggacgactgctgtcctgctatctccatggatgactgtagagcttctcggcaaaaactcgttcaactcattcagctccgtgcagcttacagaagaaacagagccgctgatcgaggcggcatcgaccatctatgaatttatcgcggacggcgattttctgcctgactatgacgcatggacaaacggtgtttttcgctggaaggaccgcgataatatactggaaggctttactgcggaatggttttccgctgccgtacaggattacatccaatacgacgatgacctgcgggagaaatgggaacatatcaaggagaaatcgcctgcggttacgacattccgcggccattttcttgatgaagaggattttctggaaggcattggctggattgacgatcaatctccatttactgtcggcttgcgcttaaatgaaccggactttgacggagacgaatggaagatcgagatgtttttacgcgataaaaagagcggtgctgtagaattctttgacggactgaagagcctcaaaaaatcgtggcaggcgtacagcgataaaatcgcgcgtgagcaggaccgctttcacagaacggttccgtggctgtcgtttgattccgggacaacgctgatctcggaggaagaagcctggatcttcctgtcagaagcaagtgagacgcttgtcgatatgggggtagaaatcctcctgccgtcttggtggcagattgtcagagacagcaacatgatgctgaaagcaaaggtgtcttcctcccgcgcggcgagtcatttgtcggcatgaatgcactgcttgatttcaactggcggtttgcgacaaatggaattgaactgactgaggctgaatttaatgagcttgtcgccagcaacaggcgccttgttaatatccgcgggcaatgggttaaaatcgatccgcagtttatcaaacagatgaaacgcctgatggaaaaagcagaatcagagggactccacatgtctgatattctggcgcgcgagctaatggatcagcaggatggcggacttgaggattcggacctgattgatacatctgcttttgccggcattcagtttgatctgtctaaacagctcaggtcactgattcgaaagctcactgccgcggaaaacctgccggagcacgaagtcagtccttctttcaaaggaacgctccgcccttatcagaaatacggcatgaactggctgctgtttctgcgggaaagcggttttggcgcctgtctggctgacgatatggggcttgggaaaacgattcaaatgatcgcctatttccttcacgtgaaggaaagcggccggcaaaaaacgcctcatttgattattgcgccgacatccgtacttggcaactggcagcgggagcttcaaacctttgcccctgatctgtctgtcgcgctccattatgggccgcgacggccaaagggtgatgatttcgccgcgcattatgaaaacgcagacgtggtgctcacttcatatggactgtcacatgccgatactgaagagctttcttctgtgacatggaacacgatctgccttgatgaagcgcaaaatattaaaaacgcgcatacgaagcaatcacgcgcaattaggaagttgaaggggcttcaccatatcgcgctgagcggcacgccgatggaaaaccgcctgactgagctgtggtccatttttgacttcatgaataaaggctacctcggcagtttgaccggcttccataaacgctatgtgctgccgatcgaaaaagaccgggacgaaaagagaatcggacagcttcagcaattaatccggccattccttctccgccggacgaaacgggatgaagaggtcgcgcttaatcttcctgagaagctggaagaaaaagaatttatcccgctgtcagccgagcaggcatccctttatgagcagcttgtcaaagacacttttgaccatatgacatccctgaccggcatgcagcgaaaagcgctgatcctcagcatgcttggacggctcaagcaaatatgcgatcatcccgcgctttatttaaaggaagagcaaaccgagctgctggccggcagatcagtcaagctcgaaaaattgctggaactgatgacagcgatccgcgcccaaaacgaaagctgcctcattttcacgcaatacattcagatggggaacatgatgaagcggctgcttgaaaaaacgttcggggaacctgtgcaatttttaaatgggagtctctctaagcaagagcgggatacacttgttgagaaatttcagaggaaagaatatccgacactgattctctcactcaaagctgggggcaccggacttaatttgactgccgccaatcacgtcatccattatgacagatggtggaacccggcggttgaaaatcaagcgactgaccgtgcataccgcataggccaagagcgctttgtccacgttcataaaatgattacgacgggaacaatcgaagaaaaaattgatgtcatgcttgaatccaagcaaaccctgaacgatcaaattatccaaagtgaaaactggattaccgagctttccacacaggagctcgaagaactgtttacattaagcgctacagcgcaataatcatgactaaaaaagctggctctagagagccagcttttttccgttcatagccgtcacgccgaatttccaaaaaatccgttacgccggttatcaacaggatgcgcttttgtggcagcacatatacttacaacaaatgtttcatcatatgtgcgacaccatgttcgtcattggttaaggtgacagcatcggctatcgatttgatgtcttcccgggcattgcccatcgctacaccttttcccgcagcctccagcatcgatttgtcatttaaactgtcacctacagcagcggtttcctcgagcggaatattcagctgttccgcaagcctcttcagcgcctgccccttggaagctttgcgggaagaaagctcaaagttgtgctcagccgaactgacaagcgtcaaatcttcggcatgctcatatcttttccagcctgcctcaagcttttctttgaagaaagaaaagccgagaatattgtaaaaatcgattggctgatcggcttcaaacagctcttgaaaggagttaatgtaagcaaagcccaattggctgtattgcacctcggccgcctgcttaaggacagaaagatccgcttccggatttgcgcttctgaatctgtcgagctcaacatcaagaagttctctgctgttttgcggcgtataaattgctgaacctgtgaatacctcataataatagttttccgactcaagccatgagagaatgtcatacgcccgtttcttatcaatcgtttcgtgatgataaagcctgccgtcgggatcgtgaatgacggcgccgtttgcactgatgacccatgttttgatccccagcggttcaaagattgacatgacgtcaaaatgagcgcgcccagttgacaccaccacttcaatgccatcccgctgcgcctgccgcagtgcgttttcattttccaagcttacctgatgcttgctgttgagtaaggttccatctaagtcaatcgcaattaatttcacgtttgtcagtcctttccttcatcctgctctgtcacgagaagctcaacgccgtttcggtcaagcaagtcacaaaatgcctgattcggcagcctgtctgtaatcaaaaggtcgatttcattcagctccgcatactgataaaaactggtgctgcccagcttagaatggtctgcaagcgcgattacctgctttgcctgctgtatcattttccgcttcaccatgccatcctcttcatgcgcaattgtaatgccatgttcggaaatgccgaccacaccaatcagcgctttatcaacatggtagcttgagagcttttcaatcacagaggacccgtacagaaagcggtgctccttttccagcttgcctcccagcagataaatttcaattccctctttatcggacagcacatccgcaagattaatcgaattggtgattacggtacaatcaaccgcattcaaatgctttgcacatgcctgaacagttgtagaggcgtctaaaatcacccggtctccatcatgaataagcgatgctgcaagcctgccgatcttatttttttcctcagacactgttttcaggcggccggaatagctttgaattttctgatgtacagtcggcaaaatggcgccgcctcttgtgcggatgatggcattctgttcctcaagtttcacaagatctcgtcgcgctgtatcccttgacacttgcaggagcgtacagatctgctccgttgtaattcggttatgctgttttaaaaaatccaaaatcgctactaatctttcttcttggtacacgccctcattccttttctcagcaatcatttataagtaattataagtttttgtttaattttattcaacattaataagtgattttaagtaaaaatacgtcgagagaaccaatttttcctaagtagacaaaaagaaagaaccagtctggtcgactggtcaattttgaggggatgatgcgaagatccggataatagtgaatggatagataacgggaggagcagggggtgtcaatcagcagctttttccggggtttagggtccataaaacgaacagtgtcagccaacacttctgttacatacacgttaacgccttccgcgttttcatagcttcttgtctgaatccgtccgcttacgccgacgagagaacctttttggcaatacaacgccgtgttttcagctgtttttctccaaagtgtgcaattgacgtaatcagcttcgatttcacctgaagcattcttgaagctgcggttcaccgcgagcgtaacatgtgcaactgccgcaccggcggaagtgtagcgaagatcaggatcttttgtaagacgtccgacaagcatgacctgattgaacatgcgattcctcctctccttgcggttgtatgtattgtaaatgatgcaacaagaaaagaaaaacgcttaaaaatagctttcagcctctgtttttatctttcgttttcatttttccttcagctaaaaacatcttttgcttttttcctttgaagaaatatgtactttttaaaaaacggaaaaagatttgctttgtcagccagttttgcgtattcatgcgcacataggaagagccatcccacgcaaaccactgaaagctcaattttttttccggcattgacagcttgattttatactgctccatgccatcttgtgtttcgtataaaaaacttattcttccttttttgttcagatgaacctcaaacacttctttacggcttaacatatatgttacttccttttgaatcaaatggctttcagaaggagcgccgtcaatataaatttcttttaaacgaaattgattcataccacatctctccgtaatccatagtcagttacagtataatgaaaaaatagaaattattaaatgtttcgctcatacaaaattctttagccccagcattgcaggattttttcctcgaaaacgtttatgttataatggaaggcaagaaaactttggaagtaatcggggtgagaagaaatgaaaacctttaaactggttgacctgaatgtggaacgagtggacaaggaagaacaatcaatcgaacagtttccccttattgacggactgattataaataaagaagacggtgaaaatcactggctgattgaggcgcttgtacagaaagaacatctgtctttttttgaacagcttcaaaacagccaatctgaagccaaagtatttgtaacgatcacgaaaaaaagcaatcgccccgcccagctgacagcagcagtgaaaaatatcgtcaagctggaagaaagcatccaggttttactctatggacaaatggtaacaagaaaacagcagggcactgaaaccattctcgagtcccttgtaaaagagggctatacaggaacaaaactcattgaagcatttaaacaaaagttataaatatgagggggcatgttccccaaaacagacacagaaccgaagagcatcacaatagacattttgaatagatatgttctgcatgaaaaaagctgccgttttgaacggcagcttttctcttcgtgctttcacacttgcatatttaatttgtatggccaaaagaatcaaccaattcccctttcacaacaaggcgcccttcagttttgacagccttgtcacatgtgattagcgtaatctcttttttgtttgtctcctcaactacatctgcatccgtttccgatatgatgtctttagatgttacagaatagatataatcctttttaaaatccgtgatgacaatttgggcacctgtttttatattctccagaggtccgaacagaagattcttttgcttcaaatgatggcccgccaacggataatttccctcacccattttttgatccgggcgcattgttgccgcccctatcaaaagattttcattggttgtgccttttacgatcggaagctccagatcgacacttttaattgttatctgcccgataaccgctttttgatcgtgatcaaagccggcctttacagcatccatcaactcaggcggctcgattgaatcaaattcaaattccgcttctctctcattattttttttcagctgctccacagttaaggccgattcactctggcttttgctaagataagctataattccacctttgatataaggagaagagatcagcagcagtccgaaaaggatgaacaccgtaatgatcattttcttgtacatgcaaaaaaccctttcttatgcatcctaaaaacgcttcgtgtcacttttcaaaaaagcacctgatcgattcttcgatgatcaggtgccttcaactttatccttttctttgtttctttcttgaggcaacagctaagcctccgcctgccataagcagcaggataccgatcattgctgtcagcatgctgtctgtatctccggtttttggagggttttgtctgtgttcgactgaccatccgagctgccatctgtaccattggtattcggatgatctccatcatcttttccatttccgcccggtgcaggtttatcaggatgatcatgcttatcaggcgttggtgttttcactttttgattagaaacaacgatctcaacagcttttgactgtcctttttcaattgtgaattcaatcggtgtttcgtcaagttggtaaccttcgggagccttcgtttcaatcaactggcagcttcccggcgcaaggccttttacagtgaactgcccattttgatctgttttccagagtttagaaagctcttttccatacccgtcagtttttacaggcttgccgctttcgtccaataacttgaattcagcgccctccaaaacggtatttttatcgtcttgatccacttttttcacatttacatcacctggtgccaaaatgttttccgcggtgatttcgactgttttcgtgtctgtgtttgtgatcttgaacgatataggagtttggtccacctcataatccttaggcgcttttgtttccacaaactgataatcgccagctttgaggccatgcaccgtgatttgtcctttgtcatcggtaaccaaaccggacttcagcactttgccgttggcatctgtcaaattgaattctgcgccttgcagaactttacgttgatcatgctgatccacttttgtgaggacaacccggttcttcgtattaaccgctgttacttcaacttgtttaggtttgccgccgttttctgccttaatggtgaatggcacagggatggcggataatagatacccgtctggcgcctgtttttcgataaattgatagcttcccggcgctaacccgtcaacttcaattttgccgccttcttttgagactagatcgtctctcactgtttttccattgctgtcagtgattttgaataccgcgcctgctaagccttttccatcctgatcttccttcgtcagctgaaccgatccttgatagttcacgacgatcccggcatcagcggattttggctttcctgctgctgatttagaaatggtaaactcttttttctccgtgtttagcacataaccggctggcgctttcgtttcaacaaaggcgtaacgtcccggtgcaaggccgaagcctttacttttccatctttatcggaagtcagctcttcttgaaccgtatttccttcctcgtcgacaatgttgaatactgcaccttcaagcttcttgccttcagcattttccttcgtcaactcaacggagcctttatgattaatggcgatcccggcatctgtagcttcaggctttccttcagaggaatcagagatctcaaactctattttctctgtgttcagcacataaccggctggcgctttcgtttcaacaaaagcgtattgtcccggtgcaaggcctgaagctgcgactttcccgtttttatctgaggtcagtccttcttgaaccgcattaccttccttgtcgataatcttaaagacggctccttcaagcttctggccatctgcatcttccttcgtcagctcaacagagcctttatcgttaacggcgattccggcatctgcggcttcaggctttcctgctgcagattctgagatggtaaattcttttttctttgtattcagcacatagccggctggcgcttttgtttccacaaaggcgtaatggcccggtgcaaggctcgaagcctcaatttttccgtctttatctgaagtcagcttctcttgaacgatctttccatcttgatcgacaatgttgaatactgcgccttcaagtttctggccttcagcattttccttcgtcagagagacttttccttgataattggtcattgcccccaaattgacgtcagacacttgattcttttcattctttgcgattgagaagtgaatcgcttttgtatttacgataaagccttcaggagcttgtgtttctgtcaagcgatagtagcccgccggcaaaccgttcatttctacttttccgtttttatcagattttatatctgttcgtatgagagtataggtgccgtcatttgattttttctccagcttaaaaacagcacccgccaaaggattgttttgttcgtcttgtttgataagcgtcaccttgttctgttgatttacgactttgtacagcgctcctggcttggaggagttgctgtctatctttacagagactccttttgcataagcatcactgatggtatatccgtcaggcgcttttacttcttttaatacataggaaccgtagcgaatatttccgaatgtaagcttcccgccggcatccgtcgtaccagtgcggaggagctgtttggagccctcagaccataactggaattctgctccttcaagagctttatcgtcctctccagtcttaaaaatcgtcaggcttcctttttctccggatccggaaccgtcgccgcttgaaatggcaacaaagatcgagctgctgttttcttgagtctgctccttcacatttgttcctgaaatggacaccttatttttaacatggccgctcgtgccggctatgttaatcagagaccggtatttgatcacataggcgcgatcaatttgcttatagctgcctatgaattttaggacaaacgattgttcacctgttgtattgtccgttttgatgtctaacgtgtagtctttgtctttttgaagctcgacatctcccgcggtcagatttccgctgctgtctttgaccactccgttttcatcatattttgcttgatatactttaaaagaatctgcatctagtatttgattttcatccggcgtgtcagtaacttttacgtcatccagcgttgattggctggagttgacattgatgttccaatcgatgtagcttccattttgtttgccgcctttgaaaaccaggcttcctccgttcgcaactgaaacagagcctgttaacgtgcggtctgcatagccgtcattatagtaggttgccttgtttgtatactgattctgatcaatgacctgtcctttgagtgatgtcttaaactcaatcagatatggtacagaatcgcctgttttaaggtgtaccgtcagcgtgcgttcatttttcgcagaaggctcttcgacatcatacttggaaggatcaagcgcgtctccttctgtgatcgagccgtttttattgatcgtataactcttaacgacaactgaacccggcacaaattgctgaggatctgttatggcatctttgatataagggtttttcgtcggctcgccgttatagttgacgccgattttccacgtgatttcctttgaaaccgcgttgtatgagccgtttttaaacccattatttgaagtctgatgattcggcgtaaaaccgcttgataccttattcgtgcgctcagtgccgttttgatcagtccatgtcgactgagctgtattcttaacgctttcgttagaataatcggcattgaatgttgtcgtataagtgatcttaaattgactgtctgtttttgcataatccccgatcaatgccaaagtaaagcctttttgatcaggtttttttgttaacgtgtagtctttgtctttctgtaatgttttgttgttcgttgtgtcttgaagcttgaacgattcatcaagcagaaccattccgccgctttcaaattgatcatccaaagtccaattgttcatcaagtatttatttttattaactgtaatcgtccaatcaaccgtcttcttctcataatcaacgtttgaatatcctttgatgagattttgctgaatggctattccagaagcttcttttgaatcccctgttccggttacaacgctattggtgtatgttgtagatttatcaatgatcactccgctgttgacctttgtttgatatatgattttgtaagcgctggttacgtttttattaaatttgatttcaaatccgcttccattatcgatgagcgtgtagtcctcgccttcctttaaaggcgtgcccgcttgctcgctgccattctgaccaaaggtaataggaataaccttcaaagaatctttcacaagatgcaaatcaccagttccaaaagaatctttaatgctggccttggattggtcgatctgtttctcaccgtagttgtatgcaagagcccagctgaatgtttgagattctccatcatagccggtcgatgatttcgcgatcatttttccatacttggctgcaacagtggcttctgcagaaatgggttccaggttgtctccgctgaatgccgccttatttgtcagcgttatatttccgccttcactcggcttcgcaccattgtcaatgtcggtttcgtatacaaggcggtaggctgaatcaattgtcccgtcaaatgtgacatttccttttgaatcaacactgtagcctgaagaaacttcatttcctctgctgacagaaccatcaatgttcacattgagttcatacactttaactgaacggtagattacgccatctggaaagctttccgtgagtttggcatttttgacttgatccaactttttattgacatcgaccgtccatgttactttaccagggttgatgcctttatccagcacacctgatttatcaatggttttactcacattgggtttaaaataaactgttgtttcaggagtatcagcattcacagggaatggaatcttttgtgttgtcgaacccgttatttttttctcgttgaactgcgtattgataaccaatgtgcctttgacattagaactttcttttacctcgccgttaaatgtcatcaccacatgtccgttcgtatcaatagaaaatgtcccgtaggtggtgtctccggcgcctaacggcaggttcacaatgtcattatgcataataaattctttaggcaaatcaaattcatatttatcgccggcattgatcgtttttcctaaatcgtcaggaatagcccaatcaattgaaattttcaccggagaattcgtattggcgcgattgcccttgtcatatggctctccgtttgcatccgtcaatgtcacgccggttaaaatatgttgcgtgatttgtttttcttcagtttgcaagcttttgaaagctgattgacttgaggatgacactttttttgaatcatcactcttagaggattcgccgctcttagagtcatctgacggctgctgttcttcctctttttgatccttgctgactgaaggtgcagatttgtcatctttcccttcctgatcacccgcagtatcagaagagtcgttttttggctcttccgcctcggcatctggtgtctcctctttcttaacaggaatgatcacctgctgggttttgcctccccctagctgaaaaagggctgctgctgtatgttcatcgtcttttacatctgcagaaaacttagctggcagtgtaatggtccccttggcatcaggagaatccgcggatgcagttgttaattttactgtcatggtgctgctgcccgccggcacttgatagctgccgatgacctgatcagcagatttgatctcaccttctgcacctttatcaaatgtaaagcttttaggtatctccacattgatttcctgtttgctatctgcttctttatcttttttcaatgaccattcatatgtcagtgtcacttcatccccggcgttaatgccggttcgtttccttttgatccgtcaacaatctgactctttgcgtccttaactgttaccgaatcgaagaattggctgtcacttgacgttacgtccacagcctgtgctgtaagagtatagctggcgatctggctgaagaagaaaaagatggcaaggcttatgatcataacgatccgcccgctttttttcagccctaagggaaaactcctcgttctcaacttttcattcctccctttcttatctatctttcacttgccgactgatccgcgagaccataacatcatgtctcatccccaaaaagaactgctaataccgaatgagtttcaaaactaagatttgccatccgaaccaaactacattgtatgaaatggaactatacaatttctgtacaactcagaaatcatgtatgattgaagtgaattggagagagttgaagtttcacccaggagacatatggcgaggccttctctttaagtgcacaaaaaaaccagtgtgcatcgaaaagcaatcgacacatactggtttggagttctttaattaatttgatccttcatttgtttgtaacgctgatattcttttatcgcatcttctaccttcccgtttttgttgaatagctgcagcttgtattgcataattttatgatcgcatggctcaattttctcggcttgcaggcaaatgtccatcgcttgatgatcgttcatttcatgaatatgataatcgatcagttcataggcctttccaagccaaagctgggaaagacgcgtcttttccggttctgcccaaagatagccgtgctccattagataatgattttgataggacatgaaaatatccatgtgcagatgtaatgtagccgtattgagcggcggcgccccttttagcgatttttcccattccacaacatcgatttttgcgcctgaaagccgaagaatatatccagtatcagtcttctcgatagtttggctgaaagggatctggctgaataattttcgtatttgataaatggttgagtaaagttgggtgcttgcttttgaaacatcgtaatgaggccaaaaaagatcgattagcatgtctttactgaccacatggccttgattgtgaagtaaaaataagtatatttcacgtgctttcgacgttctccacttgactggaatgcttgttttgacatcctttaaggtttgatgaaactgcaagctcccaaaacattggatggaaaaatgcgcctcggtattttctgcattttgtctgagcatattattcgttttgattcgttcaacagttgtctccagccgcttgtatatgacaggcttcagcaaataatcaatggcattcagctcaaacgctttgatagcaaactcattataagccgtgatgaaaacgacttggatgttttcattcatcgattgaatcgcctcagcaagctcaatgccgtttacccccggcatttcaatatcaagaaacaccgcatctacagcaggagtctcaggatgctctaaggcctcaaccggatcttgatacgccataatagattgaaaggcgtttgttcgttcaagcattttcttaaaatggagcaatgccaagtgctcatcgtcaacaattaacgctttcacaaaacatcccaccctatatgtaaaatcgagatatcagtaaataacttctattatatcatgacaaataacccctttatctggattctttttctttctattgtagtttttgaaattttgcacttacaatatttataaaaaaataggaatttagaatgatcctatttgaataaaggagccatgatatgaaagagaaattgatcttcacttcgattattttcggttacgctgcattctttatgggtttcatagccattgaccatttttccggatcaacgcttcctgcggcaaggcatggggtcatgaacttggagaattgggattttcagaaggatgggaatgtacagctgaacggaaaatggacattgtatccaaatcagattctgtcaccaaaagagatcgcttcagcaaaaggaaaagatcccttattcgttgatgtccccagcaatgtgaagctggccaagcagggtatcaatgttgattacggaacgtataagctgaccatcagatcaaagcaagacaatcaggtttttgggatcagcacgtcgtttatttacagtgccaatcgcatttactttaatggacaattcattggccaaagcggcagcccttcagataaacctgattttgcggcacaaaaccgcccatatacgagcttttttacgcttcacaagggtgacaatgaacttatcgtacaattttcgaacttcggaaaaacgccgggatggggaatcgcaaagccaattacttttggcatccaggagcaaatagtgcgggaaaacaaaatttcctttcttaatgatacaatcatgattacagcttttttcattaccggattatattttctgggctttttcctgcaaagaaaaaaagataaacatttgttgtttttttctgttatgtgtcttctgttttcgttcattattctgatgatcggaaaagagcggattatatttctcctctatccgtcaatttcattttcactgctaaattcattgagggccatctctacagtgctcgtcagcattgcggtttttctctatctcttttttgcttacagagagattgtttcaaagcgatttattcgcattgccactgtttcttccgggctggtcttagtcacagattttttaaccgtgggttttatcggccatgcctcgtacatcttacattctgtgctagcggtctcgactctggtttatattacatatatttttacgattgctgcgatccgcaaaatggaaggaagtctgtatctgaccatcgcctctatatcaatgagtgcttttgtcattttaaccaccatttcagcttatagcggcaaaacagccttttcctttaattcgatttattcattgccaacagttatcgctttgctggcgatcgttctgctgatggcgcagcaatttgccggggcatttcgtgaaaatgaagtgctgtcgtggaaattgctcagaagtgaccggctaaaggatgaatttattgctaaaacatcacatgaattcaaaacaccgctgaacagcatcattaatatatgccagaccctgctggccggcaagggaaaaagaacgatagaagaagagaaagaaaatatgcagctcgtcatccgcatgggctacaggctgtccaatctggtaaatgacattctggatttagaaaaaataaagcaaggcatgcttcaaatccacccggttcctgttgatatttatactttagtttgttcggaaatgaatttctacaacctcttatcgagacataaaaacttaaatatcatgaaccatatcccagacgatcttcctctggtgctcgcagatgaaaaccgcttccgccaaatattaaccaatttagtcgacaatgcaatcaaatatacaacagagggccaaatcacactttctgcttcaagactgaacgacaacatgatcaaagtgacagtaacggatacgggaagcggcatatcagaagccgatcgccaaaccatctttgagtcttttcagcaagccgaaacgaataaagacgatggtgccggtcttggcctcagcattgtcaaacagctggttcagctccaaaacggagatatttgggtcgaatcagaagaaggaaaaggttctgcattccatttcaccttgccgaccgcccaaaatgaatctgtctctgaaacaaaacaacgtcaccctgaattacaatccgggagagatctatcagatatctcatttagcacgccttattactctgagagtattgacgctccaatcattctgattgtcgatgataacattgacagtttaaaaattttaaacgatatgcttgaaggtgtgccctacaatgtgattgctgcgaagaacggaaaggaagcattagaaatcttctcttgcacgaagcttgatttggttattttggacttgatgatgccggatatgactggtttcgaagtctgtatgaaaattcgcgaacgattcagcatggttgatcttccggttctgatcattacagctgccattatcggccatgacaaatacaaggcttttcatgccggagcgaatgacattttgcaaaaaccctatcattactctgaatttatggcgcgtattcaaaacctgataatgatgaaacatacagcaaatcaagccacaagaatggaaatggcgtttctccagtcgcaaatcaagcctcattttctttataatgtattaaacacgattatttctctcactcatttggatattgaaaaggcccgggaggtaacagaggaatttaccaaatatttaagaatgagttttgactttcaaaatacatcagccatcagttccttcagacatgagctttcgattatcaattcctatctttctatagaaaagacgcgattcggtaatcggcttgaggttcttttcgatatagatgaagacattgactttatccttccgcctttaatgattcagcccttggtggaaaatgccgttcttcacggtgtcagcaagaaaagaggcggaggatggatcaaactgacagctaaaaaacaaagcaaaaatgagtattacatcaatgtagaggataacggtgccgggataactctcgaaaaacaaaaagatctcttatccgcggatttcgatcgcagcgtcggattgaaaaatatcaatcagcggctgaaacatttttgcggaagcgagttgatgatcagcagcactccggatgcaggcacctctgtctcaatgctcattcatctcgctgaaacaacagaaagccctgcagaactgaaggacacagaacgaacctaaacggaaattgagaaaaaaaaagacgccgtttctaacggcatcttttttattccggcgactttgcttgctgcttcagcaggtctctgatttctttcagcagctcctcctgcgcatccaccgcttcctccgcagcctcttcttctgctgcttcttttttgcgccttaacccattcaaagtccgaatgacgataaaaatggagaacgatataattaagaagttcacaatcgtctgtataaagctgccatacttcactacagcatcgccaaacgtaaacgacaggcctgaaaagtcaagccctcccagcagcaaaccgaccaaaggcataatgatatcatttactagagatgtgacgatctttccgaaagcgccgcctatcacaacaccaatcgcaaggtctacgatattcccccgcatggcaaaggctttaaattcattccacatacaatcacctgcttttctatatttgtaaagaaaaaaagacaaatgtgccgctggccatctgccttttttcaattattctccgagggcaaaagtcagttctacttcgcaaacgacttcgccatcaactgtggcaacgccttttccgcgcccgattgtgccgcgggcacgaatgatttcaacctcaaggtgaagctggtcaccaggcttgacttgttttttaaagcggcagttatcaatgcctgcaaaaaaagccagtctgccgcggttttcttctttaatcaacatcgcaacagctccgacttgagcgagtgcttctacgattaatacgccgggcataaccgggtactgaggaaaatgtccgttaaagaactcttcattagcggttacatttttatagccttttgcccgtttgccctcttcaacttccgtaatccgatccacaagcaaaaacggataacggtgaggaataatttctttaatttgctgagtatcaagcattgtcttgacatctccttcatctgcattagtatgtatagcaatcatcaaagatccaatctgtacatttgaaaagtatattatgaattaatctctttttcaaccgcgctaaaatgtaaccaactgtcaatgagagccgtcaaaagttatgatatgataattatagattttaccaatagcaaagaggtaggaaaatgatttcgaagtttattgaaaaaagaatgctaaacatgttagacgagtggtattccgcaatgagcaaacgcaaaatgaatcacgtttgcacactgaaagagaaaattgatcagcaccttccaaagatcaaaaagaacacaaaactttggatgcgttatcaattgtttcaggcccgccatcagctgctttttgaaaaccagaacggactcgattcattgttcgataacctatatggcctggaagacaaaatggatgatgaattgaaatattatctgtattttttctctgggttatatgagatggtaaaaacagctccgaaacatgcagtacatcattttaaaaaagctgaacagtacctggccgccattcaaaatacgtttgaagccgctgatttatattatcaaaccgccggcgcctattacttgatgaaatcaccgccgctttccatccaatacgtcaaaaaagcattacacatctatttgcaccaattcggctatatcaaaaaggtaatcacctgtaaacttttgctcgccgtgaattatattgatcaagaacgctatgaaaaagctgaacagcttttcaaagaaatcattaagaaaacccagcaactacatgacgaaaacctgctatgccacgcttattataaccttggctttttaaaagcgaccgagaaaaaagaccaggaagcgcttctttactttagaaaagtattaaagaatcaagaatttgaaatgaattcaccagtctcatatcttcattgtgtgtacgagtctgtcagagcgctttttaaaacaggaaacatcacagaagctaaagccgtccttcaaaaaggaaaagaattatctgaaaaggtagacattcaaaccatttatttaaaattaaaaacgcttgaagccctctacacctcagtggaagatccctatgagcagctgctcgaatatgtgcttgaattagaaaaaatcgaggcgtgggtggatttagaagtgctgttagaagatattacggaatactacaaaaaaaggacgatttcgaaaaagccgctttttttatcatgcgcggctgattgaaaaacgcccattttcttattatctgactgaattgattaaaccgagcatttgatctcccattgtgatcgttctgctgttcagctgatatgaacgctgggacgtaatcaaatctgtcatttgttctgaaatatcgacattggacatctcaagtgagccctgctgcatgccgatattttgtctattagcgccgttcagctcttcaaaagctgccgcattatcaatagagaaaaggttattcccttcggatttcagctcttgagggttattcacttggacaacgccaagattaaaccgctgaaccgcgtttccatcagttgcggttaaggtgccgttcttattgatggtgatattcttcattgagctgtcgatgttcactgtattgccgttctcatcaagtacgggatacccatttccagtgacgagctgcagctggttggcattattggctgaaggcgttaaatataatgctccgtctctcgtatactggcggtttccatttacatttacctgaagatactggtatggagacgtaaatgcgatatccagatcgcgatcggtcttctgaatgcttccttgatcagagactaggcgtgaattcatcatcgctccgacgccaaggcgcaagccgggcggcgtttttcgggcttttgccacttcctcgtttttttcatcaacctgatcgaattgctgtctgacaagctcagaaaaattcgtatcttttgccttatagccggttgtgttgctgtttgaaaggttgctgctgattgtgtcaatctgctgctgcagctggtttaaggttgttgatgccgttagcattgacctgagcatagttgatatcccccgttttttcttccgttatcttaaatttttccgatttcatttgctgctttatccatacttttatcgtaagcctgaataaccttctgattagcctcaaacgatctgtacgcttcagtcatttctgtataggcgcttgtcacatccacgtttgaaagctctgagacgccttgttttaatgaataagatacctgattatttccggctgcgcttggcagatcattaccgtccgccgtgctgtacaaatcatttccgtcccgtttgagattgcggacatcttccgccattctgacatcaatctggccggctgtgcgtccgttcgttgtcacagtaccgttttcagacacagtgaaattctcattatcaacagtgattggctggcgatccgtcgataaaatagggcgtccgttgatcgtcagctggttgttctcgtttagtgaaaatgtgctgctttttgaataacggattccatccgctgtttgaacaggataaaaaagagcagctttttcattggtttccgcattcatcggaacttgattttcaaccaatgcaatgtctgtaggctggtctgtggacttcaggcttccctgtgtgaagagaggcttgagctcctgcatatatactccggtattcacggaaccgatttccgtcctcgatgtcccggccggagattttgattctattctgctgagcagcatctcagggaacgcgcgcatcgagccttgatcagctttatatcctgatgtatttgcgttagcaatattatttgaaagcatttccgttcttcgctgctgggcaatcattgcggatgttgctgtatataatccttttaacaaatttcccacctctaaaaatggcattttttccagttgtcatataggaacgttcgttctataataaaaactcagtattttatcctattatcgtcatttaacatcttttcgtgaaggctttttcataaaaaaacctcattctttttgcagaatgaggtttgtgaaatcagcttagtttgcgtttaggaagcttgtccatattatcaagcatgacacctgtgccgatggctacgcaatccataggattttcagcaacgaggaccggtaccttcagctcttcagcaagcagctggtcaaggccgtttaagagcgcgcctccgccggtaataataacgccgcggtcaataatatcagcagaaagttcaggcggtgttctttcgagcacttgtttcgcagcctgaacaataacagcgacagattcacgaagggcttcttctacttctttactgtttactgtaattgttcttggaagaccggaaaccatgtcccgtccgcgaatggaaatttcctcgtgacgtgcgtctgggaaaacagttgcgactttaatcttaatatcctccgcagtacgttcgccgatcagcagcttgtactcgcgtttgatataatttaagatttccatgtcaaacttgtccccagccattttaatagaagaggaggtgacaatatcgcccattgaaataaccgcgatatccgtcgtcccgcctccgatgtctacaaccatgttaccgcttggctggaatatttccatacccgcgccgatagcggcaactttaggttcttcttcaaggtacacatgtttcccgccgcttttttctgcagcttctttgattgctttttgctcaacggatgtaatattcgtcgggcagcaaatgagcatgcgcggctttgagaacaggccttttacattcagcttgttaataaaatgtttcagcattgcttctgttacttcaaagtcagcaataactccgtctttcagcgggcgaatcgcaacaatattcccaggtgtacgtccaaccattcgtcttgcctcttcgccaaccgccagcactttgccgctgtttttatcaagtgcaacaacggaaggttcattaagaacaattcctttacctttaacatggatcagtacatttgcagtaccgaggtcaataccaatatcccttgcaaacatctatttatatcctccttgaaaatctgtttcacagtaaatatccacattgtgccctaattatatatattatcataaaatatagaaaaaaagttggaagcacaataagttctttacaaatttttgcggatgttttatgaacgatttcaagaaggcaatgccaggtgattacgattgctgaacaggctctccttcgagaatttcatcttttttatatttgagctttgtcgcttctcctcctcttaaatgcctgatggatttatgataatcgagtatttctttcacttcgtttgccaagtcggggttaatttcaggcagacgctctgttaaatccttgtgtactgtacttttggaaacaccaaattccttcgcaatgacacgaacggttttctttgtctccacgatgtacttccctatcttgattgttcgctctttgatgtaatcgtgcacaccactcgacctccctaaaatggatgtgagaagtgtgaaatgagatccgtattctgtaaagagtcgttcattatgccgcttcttcgttgtatggttttaaaagtaagtttgtgaaatatgcccacgatccctcacctcaaacactctctttgttaggtttgtaacagtgtattagcattcttttgggaatatgctaaaaactcaataaggacaaggggtgaaacgaactttttcagattcagcaaactatttcgcgtcactaaattttcacctttacaactatcgatcgctcctgtaaaatgaaataagcaattagttacttaggtaagttttttagaaggagaccgacatgtcctacgtcaacagacacctcattcatcaaatcaaccaaagcgcccgcctgattgccaagaaagccaatgaacagctagagccattcggcctttattcatctcaatggtcagttttatattgtttgcgtacgatcggaccaatgactcaaaaagagatttggtcctatttaaatgtggaagcgccgactgtgactcggacgatcaaacgcctggaggagaacggctgggttcagagacggcaaggtgaagacaaacgggaaaaacttgttgtcctcacaaaagaagccgagaaaaaatacgaagaaatcaatgtgaaaatgctgaaattcgaggaagagctgcttgctgatttccgggatgaagataaagaagctttttctcatttattccgcatgtttttacaacaatgaaaataaggaagtgacatacatttgaaaaaagcggatgcgatatggaccaaggattttattatggtcctgcttgtcaatttatttgtgtttgtgttcttttatacatttttaactgtattgccgatctatacgctgcaagagcttggcggcacagaatcacaaggcgggcttttaatcagcctgttccttctgtctgcgatcattacacggcctttctccggagccatcgttgagcgtttcgggaagaaaagaatggcgattgtatcaatggcgctcttcgccctatcatcttttctgtatatgccgattcatagcttttccctgctgctcggattgcggttcttccaaggaatttggttcagcattttaacgactgttacaggtgcaattgccgctgatattattccagccaaacggcgcggtgaagggcttggatactttgccatgtctatgaacctcgctatggcgatcgggcctttccttggtctgaatttgatgagagtggtaagctttcctgtattctttacagcctttgcgctgtttatggttgcgggcttacttgtttcgttcttgataaaagtgccgcaaagtaaggacagcggtacgactgtattccgttttgcgttctcggatatgtttgaaaagggcgcactcaaaattgcgacggtcggtttgtttatttctttctgttattcaacagtcacatcatatctgtctgtattcgccaaatcagttgacctttcggatatcagcggatatttctttgtttgttttgcggtgacaatgatgattgcacgcccgttcacagggaaattgttcgacaaagtcggaccgggcattgtcatttatccatcaatcctgattttctctgttggactctgcatgctgtccttcacacatagcggcttaatgcttctgctttcaggggcggttatcggtcttggctacggatcaatcgttccttgcatgcaaacattggcgattcagaaatctccggctcaccgctccggttttgcgacggcaacgttctttaccttctttgacagcggaattgctgtaggatcgtatgtattcggattgtttgtagcatctgccggcttctctgccatttatttaacagcggggctgttcgttttaattgctctgcttctctacacgtggagccagaaaaaacctgctgaggctgaaggaaaagtgtctattgcagaataacttgtcagactgccgggaaatcccggcagtcttttttccattaaaacacggcgccctcttagagaacgccgccagcctgagggagctatggtgctcccttttttcatgtcataataattgagattcttcaacactaaattagcttgttagaaactatgtactttgagagaaaacacttctgactccttcgtatcacttcattcagaaccgtgacaatatgatttacgttcaaactaaactaaatcctgtaaattattttataagtgatagaatcaataagtgaaacggtgagtattgatttattaaaattcctttttattacaaaatagtatttaagacccttccaatagagggttatccctcttataattaagatgtattacaaaatttgggaatggagatgattcacatgaaattgagaaggacaattactggagttgctttatctttaggattgcttttacctgtttctggacaagctcttgctataaatgattcaacggatggggatatgcgtacgaaggctacttcaattgtagattgttctataactccatttaaaggcgcaagtaatagattatgtatgtattcagataatggcgtttttgcaaatagtttcgatcgttttggtactacattttactttaaaggcaaagctggaaattatgcgtattatgaaagtgcaagtagataagacaacgggggcttttagcccctcagactgagagaacatctcgacaagagcgcagctttgcagcatgggtttcgctacggccgattgaggggaaaacaaaacgtaagtggcaagttcttctcccatctgcatgtcagaacatgaaaaagttcattcatcatacatgagctaaaaataaaaaaattgtagaaaaacatgagtttctctacaatctgacggcgctctcttagagaacgccgcttatggcatattattcaatgactttccgcgcaggtgaatcaggatctaacgaaaaatcataggacgcttcatcacgaaacatcgggtcggcataaatggattgctgatcgttttttgttgcttttcgatacgacgaaaatgaatcatattctttctttttccacatccatatgccgtcttgatccgcttccttgtggtacacgttatgattgaccgtatttccttcattttctgtaaaatcgtttccgataaataatctggaatcaccggccgtcaatatattcttttcaattgtgttgtttttcgtatcgtactgcagcagcagctgtccgccgtacagtccctttgtgtcattccggtacataatattgcgggcaatcagagaattgctggtgccgccccgctttttgtcatatcctccgattgaaataccggtgtacgcattgttgtacactttgttgtcagtgatctgaatggcatttgcatactttcctttgtgttcagacgttgcttcaatcccaatatcgttatcgtaaactgtgttattcttaatttcgatcttgtgtcctccatcgacataaatcccgcccgctgagtattcatctccataagcaggattgccgtaagtcgagttttgataaactgtattgttttctacgattccgtttcgcacgtaatcgtttttatccgcggttccctcataaccaattagatcgatcccgatgttgttattgttgcggaccagattgcctgcaacagtgaagccgtcgatattaccgttcagcacaactgcttcactcgctccaagcgtcagattctcaactgtattgtcctcgatttggatgtctttcatgctgccagtcccataaactgcgattccatgagcatttccttcatccgctgttgtcttaatcccccggatgtgattatccttaatggcgatatgactgctggagcctgatacataaatccctatagcagttgcttcctcagatgaaacagaaagatcttgaatcgttaaaccgctgatggcaatgtcatgtttatcgtgaatatgaatgagcggtgtctcatattttgcgttcgtaatggattcaccgctaatcacgacgttttcattttcatagtttcggaatgtgataggctttccgtccgtaccgctgtgctttacatcaagggtctcatgatacgtgccctcccgaattatgacagttgtgccggcagcagccttctcagatgcgtgtgccaatgtacgaaacggtttttcttttgttccttcattttgatcactgccatttggcgaaacatacagataatccccagatccttcctcattcgcttttgtcttatcataaacgaaagcgaggatgacagacgttaaaacacccgccaaaagaataaaataccattttctcattttcgattcccatttcgttttagaatagatttctaaaacaattataaatgttctatttatggaaaaccattcaaaaatatgaaaatataccgtctaaatagatcttattcagcctggctgacctgcgcatgttcaaccatttcaattgccaatgatgcaggcgggtgaacacgcatcagaacaatgtagaaaagaaaggagattagcacacctacaaaccaagaaatatcgtataagcttttcaatgcaggaacatacatgccaatcagcgaaatcagcgctcctaacattgtggctgcaaacgcacggtaattgtagcccttccaatacacataccgtcctgtttcggaatacaggtcatctaccgagagctcacgtttgcgaatgataaaatagtcggccatcatcacgcctgccaccggtccaagcatgccgcctattaagccaagaaacgcatacacgcttgtcgcgctctccatcagcttccatggaaccgtaaataaagcgagcaacgctgtgataaagctgccacgtttgaaattgatatatttcggcagagcattcgctatatcataagcgggcgatacgatgttcgccgcgacatttacagagatcgtggcgatgcagagtgtgatcacggacaagacgatgacataagggttatcaaaccgcgccaaaatatcgacaacatcccaaatcggctctccgaacgcgacctgcgagccggaggtcaccgtaatacttgcgaatgcgaaaagcgcaaacgttcccggtaaaccgtaaaattgtcctttgatttgctctttttgtgtttcagcaaaccgtgtaaaatcaggtatatttaagatcaatgtcgcccagatgccgatgatgccagtaactccggcagcaaacggccagaatgtttctgaaaacgtatgaaactttcctggttgagagtatatcgggcccaatcctccggcaatatcaatggcccaccataccatgccgccaaataccagatatactaaaggccctgcccacacctcaaaacgtttaatcgactccatgccgtgatgcaatacgagtaaatgaatggcccaaaagaatacaaaggaaagcaaaccggacaagtgaatgccgagaatgttccactcgccgccaatttctccccagcctggccacatattcaaaagcaaaatgttcagtgccgtgctacccgcaaaggtctggatgccaagccacatgatagctgtaaacgcccttagaagcgcggggatattcgcgccgtatatcccgtaagaagcccgaatgatcacgggaaacggcagcccgtattttgtccccgcatggccgtttaaggcaagagcgccaaataggataagtgatgccgtaataatgatcgccagcacctgccaaggcgaaaggccgatcgcaattaatcctcccacggtcgcgtaggtcggtatgttatgtatacatcccatccaaatggaggcaaagttcattgctttccacgtccgtttttcctgtcccaaaggcaccagatcttcattgctcagcctgttggattgctgctgactctcttttaatttcatagccggctcccctttccatattgtctatatgtcatcacgttatgttttttgacattagatgtcacttaatataactgaagagtcagacaataacactggctatgatatacaattttcccgtttgtatttgaacagcttaaacaagaaaaagagacagacctcagagcccgtctctttcttaagatgcagttttcattaatgcagcaaatctcacagccattaacaggcttgctccgcccgctatgatcataatgattcccatcatatcaaaatgggctgccgtgatttctttaccaaaaagaatgccaaggatcaccgaagacaaaatcgatcctaggtaacggcaggtttgaaacaggcctgaagtcgttcctaccatgttggaaggactcgttttcagcatcgctgcctgaagcgcgacatttcccagtccgtagcctatacccaagagcgatagaatgaggcctttcccaatggtctcgacattgataaaaaagatggttaagagcacggctccagccgtcatcaaaagcgctcccgcaaagatcggcttgacgacaccagatcggtcgatccatttgccggttagaggtgacacaacgatgctcattccagacataaacagcataaacaggccgctcgtttgaacagaaagatgcatttcatcctgaaagtaacttggcaaaccaaaaaataaacaatagaagaaaacattcaataaaataaactgaacatacacggctgacaggcttcgctgtgttttaaacagacggacatcaataaacggcttatccgttttcagctcgcgccagacaaacgcacagagcagaagcaagccaagcacaccttcaaccgcatgcggcgacgtgctgaacgacagcaaaaaggatagaaggaaaatgattcccccggcaaataaaacaattccaagaatgtcgagctgctgaataatggttttgattcctgccccttttttctgatctttcgggaacatatacaggcccaataagaagctgaggataataaacggcaaattaacgataaagatcgccggccagcctccccatacaatcaaaaaaccgccgactgtcggccccagcgccgtcatggcggacgcaaaaatagagagtacagccaaggctgaagcttggcgctcatgaatatgattccgaatcaagccgacacctgacggataaatcgcgctgctccccaccgattgaaacagccgcatgaccaataatgtcataaacgtcggcgcaaacggcgccccgatggcagaaaccgcaacaagaataagcccgaataaaaacaagcgtttccgcccaatcaaatcaccgagctttcccgtaaccggctgcgctacggcactcgccaagtaaaacgaggaaatcagccaggaaaccgttgtaaacgagaggtgaaactcatgctggatgctatggagcgcaagagagatcatagacgagttcagcggattcagcattgttcccgaagccaccgctgttaaaaaaacagcccggctttttttcgacaacatcatttcacttgttccagaaactcttccgtcgttcgcgatttaccgattctcgggaaaataaagcgcagtgtggcttcatgctcttcatcgctaaatgtggacatggcatctgtaataaaaatctgctgatagccaagctgaaatgcctcccgtgctgtgctttccaccccgatattcgttgcgatgccgcacaatacaatcgtatcaatgccgcggcgtctgagctgcaagtctaaatctgtgccaaaaaaagcaccccattgccgttttgtcacagtataatcgccatcctgcacaccgatttccggaacaaattcggcccagtccgccggcattttccctgaacctccctgcgcaggctcatccgtttgcggcttcagggcgtccgctccatcatgaaaggctacatttacaaagctgatgaacccgttatgtttccgaaattcatctacgagctttttcgcgttcgggacaacctggccgctttgatcaatcggcacaattcccttttgtaaatcaatgataaccaatgctgttttttgaaaatcaatgttgagtgtattcatcatacgtctcctcctgatactgttagtgtttctcacattgcatattttactcttcacactgcctaagttcttttatgatgcttgtgaaattctcagaaggagcgttttctcatgatttttcttttatgtagtagtaacaggttgtgcatacgaacaaaccggcaagcacagtaatcataaggggcgtcatcgcttcatcacctgcctgctgtctatcggttcctgcctgaaaatgcccatgaatttgcggcggtccatccaaagcaggataagacacataaccattaatatcgtgctaagatcctgcacgccaatatcaaaacaatagttaatcaagacgatgttcacaataatgggcataaaaataaccgcccctaatgcagccgttcgcggaatcagtaataaaacagctgccaggatttcaccaaaacctataaacagttcatagacatgagaataaccgaaaaatgtccacgcgatcgtaaaccccttcccggcagccgcctcgatttcaggcgtcacctcgccaaactggccaattaccactttcgccagaccgtacacgaaaaaattaaaggctaaaaacaatcggaacgtcgcgggaatcgacttgcgtaccgctttcctcagcctgccgcctttattcatcatacatccccctcagtgtattatttgatgtagtacacttaatacagtatagagtattctaattaatgtcaattcccttttcagctcatatgaatagtttcttttatagatacaaagtcttatatcgcaaaaaatgccattctccttcctttccgtccctcgataacattccttaaaaaccatgtcaggaaatcttacatgaaaatgttttatcattcttttttctctataatgaagaaatataataattgctttttattctgaaagatacggaggaatgagacatgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggcaggcctcaaaggggtcggatttgatccaggagattacagcgataccatcccccactcgttatttatgatgttccaaatgacgttcgccgttctgactacagcgattatttccgggccttcgcagagcggatgcgattcggcgcttttcttttattctcagttttatgggcctctttggtttacacacccgtagcgcactgggtatggggcggcggctggatcggccagcttggagcgctcgatttcgccggcggcaatgttgttcatatttcctccggtgtggcaggacttgttcttgccattgtgctaggcaaacggaaagacggcacagcgtcttctccgcataacctcatttacaccttcttaggaggagctttgatttggttcggctggttcggctttaacgtcggcagcgctttgactttagatggtgtagccatgtacgcgttcatcaacacaaacaccgcggctgcagccgggatcgccggctggatcttagtagaatggctcattaacaaaaaaccgacaatgctcggagcggtatctggcgcaatcgccgggcttgtcgccattacgccggctgccggatttgtcacaccgttcgcttctattattatcggcatcatcggcggagctgtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaaattgtaagcctcttccttccccttcgcgcaaccgaagaagaagagtcacttgggcttgacttaacgatgcacggggaaaaagcatatcaagattctatgtgaggagtgacgctatgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaatcgtggtcagcaaggttcctgttgatcaagtgactgagaccgctaaaagggtgctgaaaacgggatcaccaggtgacggtaaaatatttgtctatgaaatcagcaatacgatcaacatccgcacaggcgaagaaggacctgaagcactttaatatcggtacgagattcggacactccggatctctttttttgtgcacagaatcccccagaaaccgcgattcctcttcgaattctcttcaagcgccgttatttcagacaatctctatttttatttgaaacttttcatgagtaagattagtctactaaatataaaaatgtaaaaggtgattatttgaactacgaaatttttaaagcaatccatggactatctcatcacaattcagttctcgattccattatggtcttcatcacggaatatgccattgtcgcctatgcccttatcctattggcaatctggctgtttgggaacacacaaagcagaaaacatgtgctatacgcaggcatcacaggaattgcaggccttgtgatcaactatttgattacgcttgtttatttcgaaccgcgcccgttcgttgcgcatacagtgcatacactgattccgcatgctgcggatgcttcatttccaagtgaccacacgacaggtgcattagcgatttctattgcgatgcttttcagaaaccgcaaaatcggctggccgcttgtcatttttgggcttttgacaggcttttcgagaatttgggtgggacatcactatccggtagatgtattgggcagcctcgttgtcgccatcattatcgggttccttttctttagattttcagatctgcttcgcccgttcgtcgatttggtcgtgaggatttatgaaaccattatcaataaactgacgaaaaaaccaaccgatcaaaatttctaagaaagacaaaagccggcgtctttaaccaagacagccggctttaatatttcccatacatctcttgttttcttcgcttcgccaacacatataaaccataaaacaatccaataccaacagcatcgatgagcacatcccggatacaaccgttcctgctgaagaagagctgaagaacttctgtaaaaaaagcaaacgcaaatgagccggctgaagctgatcttatgctgccccgctgtttccacagcaaatatgtcagcacaaagaaggaaaacgcatgtccgattttttgaataaacgcttcagggacagtaagctcagtaaaatccataactaaaaattgagacagatcagagtgcggctgaaaatgaaaagccaccgtttgcgatacgaccatgccgctgaagctttccgtacagacagaaagcaggataaaaaagatccagcctgcgagcaataggcggttcatgacataacctcctttataacgtacgtgcctacatgtaactacatagacggtaaaacaaagcaaaaagtaacagaaaaaaacgcccatcacaaggatagacgttttcttcattaagactgttcagtgtcttctgttgtgctgctttctttggaaccagatttgtcagttgaatcatcctttttctcaccggatttttcttctgttcctttttcagttgatccgtcctttttctcggaagattgctgaatggattcttctgtttcttgggtggcagctttttcttcagcagctgctgctttttcaatagaagaaactggtttgtccataaagtttaacggattcattgcgaccccatctttacggatttcaaagtgtacgtggtttccgctgtcttcactgtaaaggttcttgccagattttccgatcacttgattttgttttactttgtcaccttgctcaacgcttacttcggaaagagattgatacacagtcgataaaccgtcggcatgttctacttccacaacatatcccagcactggatctttttcagctttaacaaccgtaccgctcagagaagcagagacatcgaaatcttttccgtctttctcagctaagtcaattcctttgcttaggctgtacgtgttattataggtaacgagtgctgcttctttctcttcttttgcggcatcggtttcatagaactttttcacaacagaaacgttttcagaatcaacaactggcattgcgacattttccattgactttcctacttcaactgcatcgtcgttgttgtcatatgcggagtttccgccgttatcagctaactgatcctttacctcatcatttgatactgattgataccaaaggacagctgttaaaatgacggccgcactgactaagtaaattgcagggaacacccagcgtttacgaaaaaactgctgaagttttttgacttgagaagttttcttttcttcctctctcattgtttcatcacctcagcaacattctgaacacttttctgaaaatatatacacctatccaaaaaacttttttagatgtagtttgcgcagactgttacgaaaatatgtcatttttttgagaggagtgccaaaaacgtatgaacatgacattgcgccttgctgaacataaagacttggaggctgttgttgcgatttataattcaacgattgcttctcgaatggtaacagccgataccgaaccggtaactcctgaagaccggatggaatggtttttaggacatacagaggcacgtccgctctatgtggccgaggacgaaaacggaaacgtcgctgcctggatcagctttgaaacattttatggaaggccagcctataataaaacagcggaggtcagcatatacattgacgaagcatgccgcggcaaaggcgttggatcatatttgcttcaggaagcgctccgcattgccccggatcttggcattcgctcacttatggccttcattttcgggcataataaaccaagcctgaagctgtttgaaaagcacgggtttgcagaatggggattattccccggcatcgccgaaatggacgggaaaagatacgatttaaaaattttagggagagagctttcatgattagtctggataaagatgaaaacgaaattgaaaatcataatgaagaaaatagccttgttgaacaggagactgcacctgttgaacaggagacccgccagctgagcgcctccgctgtcaagtcgctatccgacattgccaagtggggcaaaatttctggcatcttgttaatcattatgggatcgctggtcactctgaccgccttgatgacagtgattggcgccatcccgggcgtactgctcattatttcaggcgtatttttgatgcgctcagcaaaagcagccgcggaagccgacggaactcttaccggcgccgcgggtgaaagcatgcttgagaactatggaacgtttattaaaatgcagctgttttatgcagcatccagtatcgttactgtcctgatcgggatcattgtagccattttcgtgctggtggtaatcggcattgctgcttttgagaacacgccttcgtatgatgatccggattcttattattatgaggatgatccggtgtttgaataatgatgagacaggacagggcatgagttccatataaacggaaccatgcctattttatttgactattcaaagcaggccggcgtaaacaccaaatcctgaagcaagcatacaatagacatctctagtagtggaaatcaacaaagcaacgctgttacccagaaataaataacaaaaaaacggatgaagtcggaatcaatccgaaaccgcgctttttatttcgggtgtctgcatgcaaaaaaacacacccggatcgtctggaaaatctcaacaatccgggtgcagctcttctttaatacatttttttgcgtctgtcttcctcagtcaaaaattcaacaaaactccgcatcgcaaaaggctcttcctttatttgtcgtgcgtaggagcttttccgctcttctgaaaggatttcgctctttttgatcctgttcagcatatagatgtgaaccgttttttggatttgtttatgctgatagcctgcctctttaaaaaatgcgagaccgagcgccgccaaaatggcgaatatgcctgcgctgatcagggactccctgtcagctgaagcatgaaatagaaaagcagctaaattaaagagagagaatgcagcaagcggaatagcaagaaaacggtaaatgacggtttttttcatgaaaggctgtacggccttttgaattttttgcatttctgttttgatgaaccccggcatttgttcgactctgtaaaagttcatataatcctccccctttatttgatgtttcaagcttcacgaacgttacatatgtgtttattttaacgcaggtgcaagctggttttaaagaaatctgcccgtatttttcacgaagaatctggatcgccgctctttattcttttaaaatgtgagtgttataatttgtaatgggaatcagatcactgttattcatggaatactaatggcaatcttcttgataaatatgaatgagcggggttacaaagtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccttcaaagctcaggccgattaacctgcggctgaattaccggaaccatcgaaagcttgtgatcatagacggaatgaccggttatgtcggaggctttaacgtcggagatgagtatctagggcttaatccgaaattcggttattggcgggatacgcatatccggctgcaaggaacggccgtgcacgccatccaaacacggttcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcacgcctttgtatactgggcaacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatttacgatatcaccattgctaaaaaactggtttcaacttttaaagaagatttgctagtatccagaaaattcacctatgaggagtatttgcagcgcccgttgtggattcgaataaaagaatccgtctcgcggctgttgtcgccgatcttataagatgcgcaaacccccggcctttacggccgggggttttcctgatggtcacagtaaatgatgatcgcctcccgcaaaaaagcgacaagaccttctccatattgattgattgaatcggtaaatcgctcgtcagtgatatacacttccccgagtcctctgaaaatgtcgagtgtgcaatcgtaatgatattggcaaatatgatcgcgaaatgcccccactgcggcctgaacctctgcatcatcgggcccatgcttcattcgcgccgcaattcgtctgtaaatcgaatcaaattcagccatgatcgtgcgccaatcatctgccgagtatgcagatgtccttttctctgtttcttctgcgatttcctttccatacagctttctgacttcatcagcgtatgtctgctggtgctcttcaatatctttcatgcttaatccggcaaataaatccctcttattcatcgtttcccctccatcaacggacaaaagcgtcctgtcaattgtttgaatcatctcatccattcttcgttttttcttcttcaatatctccttttgcgactgaagtgccgctttccggtcaaaattcggatgatccagcatctctttaatttcatccaaacgaaacccgatttccttgaaaaataaaatctgttgcagtctttccagatctgcgtcactgtacaaacgatacccagcatcagtaagcgctgaaggattcagaagctcaatattgtcatagtgatgaagcgtccgaatgctaacacctgatatctccgccacttgtttaacttgatatttcatacataacacctcctcttttttatcgtaaacaatcacgcaacgttagggtcaatccccaaaatgttattttctatatacaaaacttctcacaaatagtgtataaaagaaaagtgagtatttttttgtaaaggggagccagtatacatgaatcctgaaacaatgaacaaaaccctcatcagcatttcgaaatggggaaaagctacaggcattttatttattattatgggcgcaattaccgcgctttcaggcgcgttcatttttctaatcggtgccgtgccaggcgtactgcaaattatttccggtatctttttgatgaggtcagctagggaagcaggccaaatggctgaacacaatagcggacagtctgaagacttaatgctggagaattacgcgaaattcgtaaagatgcaagggatttatttgatcgtaagcattgctgtatccattcttgcgattatcgccttcttcatctttttaatgcttgggattgctgacggccttttcagcgatacgtacagcacttattaatgagaaaaacccggagctggctccgggttttttattattccgcttcgcttaccactgtgaagcgttcatttttgtgttcgggatgttcaagctcgtccaacacggcaatggcataatctgcatagctgatatagctgtcgccttttgcatttacgatgacattgtcttttcctttttggtaagagccagtccgttttcctgctggatcaaaaaatgccgcaggactgaggaacgtccaggaaatggagtctgtctgctgcaaatctttcaggttctcgccttgatttgatgcagttggcaaatattctttcggaaattccggcgtatccattaaacgggttgttttggcttcatcaacaaacaggcttcccgctccgccaacaacaagcaatcttgtgtgcttcgcgtcctttaaaatgctgatgagtgctcttcctgcttcaacatgaagatgttcttggccgggtgctgctccaaaagcgtttacgaccgcgtcgaacggcttgatgtcttccgcagtcagttcaaacacatctttctccaaaaccgctacgtcctgctcctgcacttttgaagcgtttctgacgatggctgtcacttcatggcctcttgttttcgcttctttcaaaatctcgtttcccgctttcccgcttgcgcctataataccaattttcatttttcatttcctccttatttgtaacaattttagttacatgttagcggtgagaagtcatcccttttgattaaaagagatgattcataacatcttttaatgacttgctcgccagttcattttccatcgctctttgcacactttcaaacgtttcatccagagcgttctgaatttttttccctaccggacatttcggattcgggttttcatgaaccgcaaagagttcttcttgcttttggacagcccggtacacttctaaaagagaaatatcagcaggatcttttttgaggcttgcacccggcaccccggcgcgtgatgtgagaatatcagcttttttcagcaggctgatcattcttcgcacaactaccggattcgtgttgacactgtctgcaatgatttctgaagatgttttttcatccatcgagatgagggataaaatatgaatggcaacagcaagacggctgttaatcatgttttttcaccaccgttgtaactataatagttacatttgattcatttgtcaacatctaatatacactaaatacatgggttttgtgcaccgtttttagtcaatagaacggccggatgcactccggccgcgtcttatcagaataagaaatatctttgtccaagggggacataatcgacaggctggcaagacaattcctccccgtcagcaaagacctgataggtttttggatcaatctcaatcttcggcaaagccgaattcagcttcatatccagcttgctcagctttctgatatttttgactggagaaatccttttttccagccctaagctttccgccacaccacgctctatgcttgcctgagacataaatgtaatcgaggttgagcggttggcttttccgtaagacgcatacatttggcgcatgaaaaccggttcaggagtcgggatggacgcgttcggatctcccatttgcgcacgtgcaatcatgccgccctttaagaccagttccggttttacgccgaaaaataccgggtcccacagaacgagatcagcaagcttccctttttccaccgagccgacttcatggctgagcccgtgcgtaattgccggattaatcgtgtatttggcaatgtaccgttttgcgcgcacattgtcatttccgttttcgccggcaagagcgccgcgctgttttttcattttatcggctacctgccatgttcggatgatcacttcaccgacccgccccatcgcttgggaatccgatgatgtcatgctgatcgcaccgatatcatggagaatatcctccgcggcaatcgtcgcagccctgattctggaatggctgaacgccacatcttcaggcactttcgcatctaaatggtggcagaccatcatcatgtcaagatgctcatccatcgtattaacggtataaggaatggttggcgttgtagatgacggcagaatgttcgcataagaagcgagcctcataatatccggggcatggccgccgcctgcaccttcaatgtgataagtatgaatgacccggtccccgatcgcgtcgagcgtgttttccaaaaagcccgcttcgttaatcgtatcggtatggatggcaacttgaatatcagcctcgtccacgacttccatacacgttttaatggcgcttggcgtcgtgccccagtcttcatgaagcttaaggccgatggcgccggcttccacctgctcgatcagcggcgctttatcggatgcattccctttccctaagaagccgacattgatcggaaactcctcggccgcttccagcatccttgccatataccacgcgccggatgtacatgttgtcgctttgctgcctgttgcgggtcctgttccgcctcccaaaagggttgtcacacctgaagaaagcgcaacttccatctgctgaggacaaataaaatgaatgtgcgtgtccactcccccggctgttaaaattttgccttcaccggaaatcacctctgtccccgctccgatgaccatgtgcggatcgactccatccatgatatcaggatttccgctttttccgacaccgacaatccggccgtctttcacaccgacatccgctttgacaatgcctgtgtaatccaatagcacgacgttggtgataaccaaatccaaagcgccgtccttccctgtgattctgccgttttggcccatgccgtcgcggattgtttttccgccgccaaagatcatttcttcaccgtatactgtgaaatccttttcgacttcgatccataaatccgtgtcgcccaatctgattttatcgcccgttgtcgggccaaacagttccgcatattcctcccgtgacattttcatcggattacaccctccatccagccggcttgttttaagttggccaacgttttttctttgccgcgttcatcgataaacgtgtcggccattccgttcagccctttaattgtcttgcgtcctctgatttccactagtgagaccgttttctgctctcccggctcaaaacggaccgacgtgcctgatggaacatcaagacgcatgcctatcgccagttcacggtcaaataataaagccccgttggcctccgcaaaatgaaaatgcgaaccgacttgaatggagcgtgatccggtgttttttaccgttacctcccgtatctcacggccttcattaatcgtaatggttccctcagcaatttgaaatgctcccggcttcatgacttcacctccgcagaaattggctgatgtaccgtaacaagctttactccatccggaaatgtggcctccacctgaatgctgtccagcatctcaggcacaccttccatcacatctttttccgttaatacatggcggccggcttccatcagctctgctactcccttcccatcacgtgcgccttccataataaagcaggtgatataagcagcagcctcaggatagttcaacagaacgccccgcgcctttcgctgtttggctaattcccccgctgcaaaaatgagcaatttttcttgttcaaccggtgtcagtttcatctgtaatcctccttcttttgtcatataaagcggatgcggttactacgaatttgtggagcatgcaggcgggacatcacctccctttcttcgagaatgggggtcatacggtagggtgcctttcaaatcggcatgccgtttcttcatcagccttgccatggtcaacaaccgttcccctgtcgattacagaaagatagtcagcacagattaacgcgttttccagactgcgctcgactaagataacaaatgtctttttttctggaaatttctataataacttgtctgactagttcgacaattaaaatctgaattccttccaattgttcattaagtaaaatatttttcggatttaccatcagcgctctggcgattgcaagctgctactgagaccgccttttcgttttgaacaaacgtttgattaaaacaaatagcccccctgtttagccggaagcaggcctatgaagtggattggccgactccatttcggcctaatacagcgacaatctgccccgggtgaacctccatgctgaggctgtgctaaaccatcgattgatcataaccagacgttacatttctgatggcagcccgttgttttgctccgcaaccggaagcatggcatggaggccagtctgaggcgccgtcctccacgataccgagaacccgattattgccattaactccgcatcatagacggacacttcgctgatcgccaccgttcggcttaacgagtgaagaatcccgaccttcactgaatcccgcttgtgtcgatattaactgttttttcgcactcccgctggcttccggcactttcttcggtgcagtacattccgtcatcaaaacccctttgtttgatttctccaaatgatgttataaaactttacaacttatgtcattattatatagaagaggcctattaattcaaagaatatttaaaaaatttagttaccttgaccaaatcagcttctttttttgttatatttattcacatcagaaaaagcgaacaaaaaaagacaagaaacatttcgtttcctgcctcttccgtacgattaatctttatctgaaaatttatccttggctttcccgatatccttttggatttcgccttttgccttatcttttttgccttcagcctgcatgtccgttctgtcagccatatctccgactttatccttcacttctcctttggctttattgaagccgcccttcattttgtcttttacactatcgttacccatgttaattctcccctctcaattatgtgtgtacttgttaccttcccgatctgagaggcaataaacattctaatgttatttatcgatttcgtagcgctctccgtaacggagcaccttgtatatcgccagcccgtctgatgactttttctccgaatatcggaccggcagcagggcaaaaaacacataatacgtagaaaaatagacaaactgatagaaaaacacattcggctttaatacactgtgtataatcagcagattgattgcaaaaatcgtgatgaggttaaacaagcagccccctgcatacacgagtgcatttgagaatcgattgtcaattttcaactccccgtaccggcaaaaagaatcgataaaataaatcgttctgaaccgtatgggtccaattttaagcagcgtttttcccatgcctatatccaacgatccctttccgccaaaaataaaagccataaagctgtgccctgaaacatgtataatctgtacaagcggcagaacaatgaggaaagaccacagaaacttcaccatatcattaaaaccaaacattgaattccccctcacatgcatatctgcatcccaaaacggcttttgttcaaaaaacagtgctgtagcgatttttcctgttctccccggaaataaacgttccgatgctcccctttttttgcataaaaaaaaaccatctgccagcagatggttttgtctcatacttcatataaacaatcgttcctttgaatcatctctctcatgctgaccgctttttcataaaaatacaccgcttctttatattgttcgcgatgactgaaataggaggcagcatctaaagcaaattcttcaatatatacatacaggcccttttcttccatataatcaaatacttcttgaatcatattcaaattgacagattccacatataatgcctgcagaaatttatattttgccagactgaagaagtcgtttcgtttttgggcaatggcaatccctttttcatagtaccgcatcgcggcttcgctatcttgttttttgaaaagaacgcgagtcaggctgaagagcgcttttggaagctgttccagctgataatcctcgaagacaggaagcgctttttcaaagtaatcggcggcctgatccagctcccccttgtcatcatagcaattcccgatattataaagggctgatccgatcaaacggggctgtccttccaataaagcaaggcgatacgcgtcatctaaatgttcaagcgctttttcataatttctgtagtctatgtagtttcctgatatgacgaaatggcattgaattcttctgactctataaaaatcgtgagccttatacgtctccagcgcctgtacagcgtggttcatggaaaagtgcgtctgcttcataatataaaagacttccgccactttaaaatgaaattccgctctttcaatttcatcttctacaaacgcaagcatcttctcagctttccgataaaaggatatagccgagatgtaattgttctgttcaaattcgtacattcctctaaacaagtgaaaataatactcagataatccggagatgctgtcctgattgctttccagcgttttgatcaattcacgatattgaagctgagattcctcgtgcaggtcaggctttacataatccagcataatttggtgccggtagctgatcagctgataatacaggagaagcagctgatcctcttccatctgttcgatatctagatcaatttcttccttcagctttacggcatcagccacttgaaatgctaaaatgtgcttataccacttattgattttcactcctacttgagatgacgggatctcgtacgcggccatgcccctccaaccctttctattttctaattggttatattttatcataatgtatggctttggaattaaattttcttacaatgattccttctttatgcctatccttatatatttcggtttttatacgtattttttgcactcggattctaataaaaaagcttatcggacagtgccgataagcttttgacttcaaattaaccgccaatataagacatttccactttctttttgccagatgcttttgatagcgtacgatcgactgaatactgatcaatccgatttttccatactgtcccgatcatttctgatagttcgtcatcacttaatttctggcgaaccggagctctgaggtcaaatccgcttgaagcgaataagcaggtaaacagctctcctctcgcagaaagacgggctctgttgcaagatccgcagaacgcatcagatacagatgatatgacgccgatttctccggagccgtccaagtagcggaatctggaagccacttcgcctatataattaggcgctatcggctcaaccggcatgtgttcattgatcaaatctatgatttccgcctttgtcatgacgtctttcttttcccattggttggtgttgcctacgtccataaattcaatgaatctcaggatatgccctttttctttaaaataacgggccataggcagtatatctttttcattgacgcccttttgaacgaccatattgattttaacaccgagccctgcttgcttcgccgcttcaatgccttccagcaccttgctgacagaaactccacgcccgtttatcttcttaaaacgctcgtcttctaaagaatcaaggctgatcgtaacccttttcaacccagcctccttgagcctctttgcataaacaggcagcagtgatccgtttgtcgtcatcgcgatgtcacgaatacccggtatgcgggccagttttttgattaactccggcatatcctttctcatgaggggctctccgccggtcaggcggattttttcaacgccaaatcttgtgacaaacaatgtcgcaagccgttccagctcctcaaatgaaagcagctcctctttctttaaaaaaggataatccgggccgaataattcggcgggcatacagtacgtgcatcggaagttgcagcggtctgtaacagaaatgcgaaggtctctcagcggtctgtttcttttatccaacatctgacgcgactctgtaatcatagctacagccccttcctatcccctgattctctcagggtgtgtatatacattaaatgatccgtttctgacaaatccaatcgctgtgatattcaattcttcagccatttgaatcgcaagctccgtcggggccgatttggaaatgacaatcgacacgccgattttggccgcttttaacaggacctctgatgagattctgccgctgaacacaatcagtttgtcgcgtacggacatcccgtttaaaaggcagtgtccgtatagtttatcaagtgcgttatgccgaccgatatctgtgcgcatcaacagaagcttctctgtgtcgcaaagcgccgcattatggacgcctcccgtatcctgaaacgtcccgctcccttgctgcatgtctttcataagcgccagacatgcctcaggcgatatcttgatttggctgacagccgtcttggctgttttgacatcctgctgaaaataaaaatgacggccctttccgcagcatgagccgatcacccgtttcgtataatccttttgatccaatgtctcagggtgaacgaggtcgacatatacaaaaccgagactttcatctattgtaaaccttttaatttctttttgaaatcgtataacaccctctgatgcgagaaatccgatgacaagctcttcgatatgctcaggcgtacaaacgagcgtcacaaattcactgccattcagtatcactgtcaaagggaattccgtcaccatccggtcttctactttgcttatttccccttgttcatagcgccatacatccctgaccgcagttactttatcgttcaatgtctcttcccctccgcaatgttcctgcctttatattttttcacactcctcggattttgtcgaattctgagacacaaaaagagccctctatataaagggctttcacaggatgtgatgacggcggtgtttaggcagggcgcctaagcatttagccgccattccttttaccaatgtgcattgacaacgaacgctgggcttgtcgacacgctgagagccctctatagaaaggactctatggttgattatactgattctttttcagaaccgtaaacagcacaatagctgcgatcaaggtgagaatgctgacaaaaaagaaggctgccagttttagaagaacaccaagcaatatgaatgcaacggttgctataagaaaaatcattccgaataatttcatatgttcaacccctttttagggtatcattcccgcccaaactgtttttaaaccaataaaaaaaggcgcctggggagcgcctgatctttaggttccttactcagtaaatttttgtgcttctttttcccaagcctgttcgaactcatccgcactgttcgctgaaatatattctccgccgccagcgacagctgcttgtttcatctcttcattacccttgacatcaaagttgaagccaatgatgtttacaatcgtatccacatttgatgcacggagcttttcgatttctgccgcagggtctccgccgcacgtttcttcaccgtcagtgattaaatacaccacgtttttcccgtctgcgtcaaatgcttcaaattcttttcttgtgtctgcaagtgctttggcaatcggtgtccatccagtcggcttgagctcactcaatgaattgtcaaacagagacccttcatatggatgaaggccgtaaatggtttccgtcgtactgcacgaaagggctttaccggacagtttattgttccctgcatgcccgaaaacgcgaagcataagatttgtatccttcggaagaagttcggcaaaagattttactgattttttggcaatgtctattttgcgctctcctcctgttttttgaaccatgcttccgcttccgtcaaacaaaacagctacatttgtatcagcctgtttctcagcggcaaaagacggggaggcaatggaaacagtcaacaatccaatgataccggcagccagcaattttttcatacgattacttcctttctttttcatattttccaactatatgttggattcttctttatgctagaatacgaaaatacaaaaagatataggacatgctgccttttgtgctgctttcacgatctgtccaaaatcgcttgaaatgccgttcatttttagccatttccgcccagaaagcataaacagattgtgtgatcattcattcttttttcgccttgattatgacagaaaaacggaaatctgctactatgctacaggcagacagctaattagttttgaagtttttgttacatacaaaaagaggctgaccatcaccagcctcttttttcttatttagataacattagtgattgctgagtgaaaattttctcaacatctttttgggtataagccgggaagtattcaccgccgcctactttcgcaattgcgttcagctggcctttgtatccctctttataatcaaagccgatcacattaacagtgatattgtctttttgcagttcctttgctgttttaatcgggtttcctccgcacgtttcctcaccgtctgtcaacagatacaccactttttccccttttgcatcaagctggtcaaaagaagattttgcctcgttcagcgctttggcaattggcgtccagccagtcggcccaattgtattgagagaattgaggaagctttgctcgttaaagctttggaagccgtatacgttgcgaatggcttcacatgactgaacttttccggaatttttattgtttccttcagagccaaacacgctcattttcacctgagttccttctggcagtgagcttgcaaactttgaaatttcttttttggctgaattaaatttagagacaccgtctattcttttcgccatacttccgctggcatcaagcaagactgccacgttcgcaggagctttagcctccgtttctttcttttcagctgcaaaagcaggtgaagttaatccaaaaagcaatcctgtcatcatgatcagtgaaaatcttttcttcatgttcgtacccctttaccaatttgtttctgcgtgcagatgttcaacgctgaacataatctatcgtaatcaacaaaaaccgagaaataaatagggcgggcttccccattgctgttgtttacttttgcatagaaacctatgtttttattagtgatttccacctaacgcccctatgaaaagagaagattgtccgcctttcggctttcgttatatgagtctgtcgaagtctgtcgactaatgtggatgactttaccacaatctcaaagcctgaaatcaggaaaaaaggactgatccttaaagacggtcagaagctcctctaaaccgtttcaactgctcttagataaaagatattcaggaacagaaaaagacgcccaaagagcgtctttttctactttttcgccatatatttattcaaaaacgcatctgcctcagaaatttgtgtgccttggtaatagtactttacaatgtcatcaaccgttttgccttctttggccataaaattcgctccgtattggctcatccccacaccgtggccaaatcctctcgtcgtgactgtaattgtgtctccatttcgcttccattcaaaatcggcggagttgagacccagcttttcacgtatgtctcttcctttcagcgtcttgccgttaatgacggcagttgcgacctggtggcccggtgtctcgccggtaatcttccctactgcgctagatccatccagcttgacgccaagcttttgctgaaattctgccgctgtaaaggttttcgttgccttatatttcggagactttttatcccatgggcttttgacgctttttaaatatgggatagcacttgtccaataagcttctgcattctctgtgtagccgttgcttgtggagaaaaaggatgcttcaatcggctggttgttgtacgttaagattttgccttgcgtactggctaccgcagctgtgattttcttcagttttgtctcatagcttgtgccccactgttttttcagctccgctttgtttttatacacctggaacatctgtgtatcatccaccagtgagcctttaggagcctcaaccgctgaatttgacaccatcagtctgacaataaatgttctggcggcgagagcctgggctttcaatgcttcagattcaaaggttgccggcatttcggaggcgacgactccaatcacatactcttcaagcggaatgttttctacggattgatttgcggttcgatagacgggaatagaaacaggtgatgctttcaatgtttctgctcctttcgatgctggtttcgtgctgactgctgtcttttctgattctatgctggcccccgcttccttattatgctggaatggtataaccaagagtgtgggaaccaagagaatcaatgcacatagtacggatagtgtgattgcgaattgtttcatattcagctgcctcctgctcgggattcgactctagtctagtctatgggcagggacaagctaatatgactctcgttttggacagaaactttatttgtcatttacgtattcttttttgctattttgcgcataatgatgataatacacaaaaaataaaaaaccagtatgccagagtgacatactgattttcaagtaagtttatgcatttaagtcagaaacgacttctttattctcttgctcagaagcagacacatcatttacacgttcgatgtctgcgcccagagcggcaagcttcttatggaaatcaacgtaaccgcggtctaagtgcttcaattcagtaacacgtgtgtgaccttcagccactaaccccgcaagaatcagcgctgcacctgcacgcaaatcagtcgctgcaacttcagctccctgaagctgtacaggaccgttaatgatgacagaacgtccttcaatcttgatatcaccattcatacggcggaattcttccgcatgcataaaacggttttcaaaaactgtttctgtaatcatgcttgtgccgcttgcacgaagcagaagcgccatcatttgtgactgcatatcagtcgggaagcccgggtgaggcattgtcttgatgtcaatcggtttaagttctttcgggccgatgacacgcagaccttcaccttcatccttaattgttacacccatctcttccatttttgcaattaaagaggtgaggtgttcaggaacggctccttttactaatacgtttccttcagtgatcgcagcagcaaccataaatgtgcccgcttcaatgcggtcaggaataatatggtgttttacgccgtgaagcttttcgactccttcaattttgatggtgccggtgccagctccgcggatttttccgcccatgccgttgatatagtttgctaaatcaacgatttcgggttcttttgccacgttttccagcgttgttgttccttcagctagagcggctgccataatcaggttctctgtagctcctacacttgggaagtccagataaatttttgcgccttgcagtcggccttttacttcagcttcaatgaagccattaccgactttgatttttgcgcccattgcttcaaaaccttttaaatgctgatcaatcggtctggaaccaattgcgcatccgcccggaagtgcaactcttgcatgacctgtacgcgcaagaagcggccccatgacaagcacagacgcacgcattttacgaacatattcaaaaggtgcttcagtttgcaaagcgtatgaagcatttacagtcacttcattattttcaaaatgcacatctgctcctaaatgacgcaacacttcgttaattgtatatacatcggagagcgtaggtacatcacaaattacgcttttttcttcacttgctaataaagatgcagcgataacaggtaaaacggcatttttagcgccttcaactttgactgtgccgtttaacttctgaccgccgcggacgatgattttttccaaggtattcccctccgcgtccctaaattctctatattaatattcagtcgtaacgattggtgtgccaaccgtaacggtatgttttccgcccattcctgcacttctaagtgcaatttgcaaattcattttatgtttcgaggtcataatgtactcttcccactcatctgtaaacgcagaaatagaaacgaaatttggctcaactacatgttctactgatcttgcttgaaattcatttaataactgatttgcttttttttgcaaaacaatattcatattatcatctaagtgaccatttagacaagtaaaaataactactttttcttggaatatcccaagtgtctcccgttcaaactgttcatatgtatcattccagctatccggtgtctctagactcatttgctcatataataaatacgaagttggattgtgttttttgagggttgtgacaagctgcagtctaaaagaagtacgattttttttgtcagtatatgtgccaattgcctttatcattttatcttcccgtgcaatcacccaatcatattgacgatactctgattttaaacgttgcactttttgataaaattctttttcggtcagtgacatgttttgttttgcatgcaatgtccacttatctattgacacatcttggcgttccatcccctctgccatttgtgctaacggcgttaattcactcgcatggatggtatggaaaacagcaatgacgaagcttaacatgacggaaatgataatagcgtggcttacttgttttttcttcatgttcatctctcccccttatccccagttttaccggaggcaagaggcgccatacgtaaaaatcttcgtcaaaactcgagctattcgcttcaacccgcttctcccaaccatttaatgataataatgttcaaaacctattaaaatagatagggaagctgctgtgaataattgagataatctaaaaagaaattggcaacggccgttccaatggcaattgtcagcaaaatcatcaggagtctagcctgcacgactttgccttttttggttaacggatctatattgacggcttgcaacgcccaccaagtcactgctataaaaatcaggtgaacgacaatgccgattgcagcctgctgtcccaatacactcatctattacactcctttctctgcgttcataccctttcttattatataagaagcacagataaagatgatacattttatacagaacggaataatcagccaaatctagggctaatccctgcttaaagtgcgattcttttacatggtatactttattggaaaggagctggcaaatgtgaatcattctttttttcagcctgaaaagcaatatggtgaggacctgccaatttttgatcaggaatgggaagcaattgcattctattatgattatagacagtcacagattgaagaactgaatgaattgtgtcagttttttaacatttctcttacctatacgagagaaagccttgaagagcttgaaaacctctattttcaaagtatacaagagcttttgcttgctgattggaatcttcctattgaagaattcgagaaaatgatcagtgtttatcttatagattgcgtgattgcccgccatgaagatgctgaatgggttgtaaaaccttatccctataaagacggcgcttatacacttggctttagaagacatcgcaaatcgtggcatacaatgaatgcctgtgatagtttatacctgcgccaaaaagaggatcgcccgctgctgtcgctgtttgattctcttgttcgttcataaaaaaatccttctcataaagagaaggattttttcttatttccctgctacatccaatctgttcaaagcccgctgtaacgcaagctcagcccgacgaatgtcagtatcatctgattgagtattcaaacgctcctgcgcccgctggcgtgcagcttcagcgcgctctttatcgatgccttctgctgtctcggcagcctgggcaaggatggtgacctgatcaggacggacttcgacaaatccgccgctgacggcaaccatttcagtctgcccgtcttttttcagacggacagcgccgattttaagaggagccacggttggaatatggcctggcaaaataccgagatcgccgctttcggctctcacactcaccatttcgatatccgcatcgtatactgggccgtcgggagtaacgatattgactttaacggtcttcatgcttttaccctcctaggaccagattaaacttctacacccatttcttttgctttctcaacaacttcttcgatacggcctacaagacggaacgcatcttctggaagatggtcgtatttaccggctaagatttctttgaagccttgtaccgtctcttttacaggcacgtaagaacctttttgtccagtgaactgttcagccacgtggaagttctgagaaaggaagaactggatacggcgtgcgcggtgaacgacaagtttgtcttcctcgcctagttcatccataccgagaatcgcaatgatatcttgaagctctttgtaacgctgaagcgttgactgtacttcacgcgcaactgcataatgctcttctccgacaatttcaggagcaagggcgcgtgatgtagatgccaacggatcaaccgcagggtaaatacccatttcagttaatttacgctcaaggtttgttgtcgcatccaagtgagcgaacgttgtcgccggcgccgggtcagtgtagtcatcggcaggcacgtagatcgcctggatagatgtaactgatccaacgttcgtagacgtgatacgctcttggagctgacccatctcagttgcaagcgtcggctgataaccaaccgctgaaggcatacggccaagaagggctgaaacctctgaacccgcttgtgtgaaacggaaaatgttatcgatgaagaacagtacgtcctgtccttgtacatcacggaagtgctcagccattgtaaggcctgtcaaagcaacacgcatacgtgcgcccggcggctcgttcatttgtccgaataccatggctgttttgttgattacgccagagtcactcatttcgtagaaaaggtcgttcccttcacgagtacgctctcctacgccggcgaatacagagataccgccgtgctcttgcgcgatgttgttgattaattcctggattaatacggttttacctacaccggcaccaccgaacaatccgattttaccgcccttaatgtaaggagcaagcaaatcaacaaccttaatacctgtttcaagaatttcaacttctgttgaaagctgatcgaatgaaggcgcctgtctgtgaatcggatcctttttcgcatccgcaggaaccggctcattcaaatcaatattttctccgagaacgttaaatacacgaccaagtgttacatcaccaaccggtactgagattggcgctcctgtatctacagcttccataccgcgctgaacaccatctgtagatgccattgcgattgtacggactgtatcatcacctaaatgaagagcgacctcaagcgttaaatcaatacctacttcgttttcacttgcagctggctgtgaaattttaatcgcattataaatttcaggcaagtgaccgtcttcaaaacgcacgtcgacgaccggtcctaatacctggctaacgcgtcctttcttcatcgctatccctcctgacaaaatctttctattctaaagcggctgctccgccgacaatttccgtaatttcttgtgtgatggctgcttggcgagcgcggttgtaagaaagcgaaagtgaatcgataagttccttcgcgttgtctgtcgcgtttttcatcgccgtcattcttgcagcgtgctcacttgctttactgtcaagaagcgcaccgaagattaagctttctgcatattgaggaagcaaaacctccagaacctcctcttcagatggttcaaattcataagacgccgttctttttccgccgccgctgcccaaatcagataacggcagaagttttttctccgttacttcttgagtaatggcgctgacaaaatggttataaacaaggtgcaattcatcaaacgcaccgtctataaacatttggatcgtttgacgggcaagatctttaatttctgtaaacgttacttcatccccaagtcctgttaactcggaaatgatcggaatctcacgtttcttaaagaaatcacggcccactcttccgatggcaatcaccgcatactcatccttagactgatgacgttcttgcatggcctgataagcactccgtaaaaccgaactgttaaaagcgccggcaagaccgcggtcagacgtaatgacaaggtatgccgtttttttcacttctctgctgagaagcatcgggtgctttacgttgccggaaactcttccgacgtttgacacaacctcttggattttatccatatatggcacaaatgattttgcattgttttcagcacgattcagcttagccgcagataccatctgcatggcttttgtaatctgacttgtttttttcgttgacgtgatccttgacttaatatcgcgtaatgaggccaaagatttcaccaccttttctcttcatctgcgtaaaaagagagaaaaagagaacctttttctctcatcagcattcgagttagttgcttggtgcaaatgtgcgtttgaagccttcgattgcagctttgaagtcttcatcagcaggaaggtttcctgtttttgcaattccgtcaagcaggtctttatggttttggtcaaggtacatgtagtactcttcttcaaaacgtctgatatccgccacaggaatatcatcgagatatccttttgtcagcgcataaagaatggctacttgcttttcaaccggaagcggcttgttcagatcctgcttcagcacttcaactgtacgcgcaccgcggttcagttttgcctgagtcgcttggtcgaggtcagaaccgaattgagcaaatgcttccagctcacggtatgacgcaaggtcaagacgcaaagtacctgatacttttttcatcgctttgatttgcgctgagccgccgacacgggatacagacaatccggcgttgatcgctggacgtacgcctgagaagaacaaatcagattgcaggaagatctgtccgtcggtgatggaaatgacgttcgtcggaatataagcagagatatctccggcttgtgtttctacgaacggcagagctgtaattgatcctgcgcctttcgcgtcgctaagctttgctgcacgctcaagcagacgggaatgaagatagaatacatccccagggaacgcttcacggcctggcggacggcgaagaagcaaggacagctcacggtaagcagccgcttgtttagaaagatcatcgtatacaacaagaacgtgcttgccgctgtacataaattcttctgccattgtaaccccagcatacggtgccaggtacagaagcggtgccggctgtgacgcagacgccgttacaacaattgtataatcaagcgcgccgtgtttacgcaatgtttctactacgccgcggactgttgattctttttgaccgatcgcaacatatacgcagatcatgtcttggtctttttggttcaggatcgcatcgatcgcaacagatgttttacctgtttgacggtcaccgatgatcagctcacgctggccgcggccgattggaatcagtgcatcgatcgctttgataccggtttgaagcggttcatgaacggatttacggtccataacgcctggtgcagggctttcaatcgggcgagttttgcttgtaaggatcgggccaagtccgtctaccggctggcctaacggatttacaatacggccgattaactcttcaccaacaggaacctccatgatgcggcctgttctttttacttcgtctccctcacggatctcactgaaaggtcctaagatgacgatacctacgtttgattcctcaaggttttgagccatacccaaaacaccgtttgaaaattcgacaagttcaccggccatacagttgtcaaggccgtgcacacgtgcaataccgtcaccgacttggatgactgtacctacgtcttgaacttcaatatcagattgataattttgtatttgctgttttatcagcgtgctaatctcttcagctttgatgctcacttaggtttcaccccttctatcgattttccccggctaattgacgttcaatgcgctgaagcttcccgcttacgctgccgtcataaatccggtttccaatgcggactttaatgccgcctattaaatccgtctgcacttcatttctgattctcagtgaagcgactccggctttttttgcaaacacttgtgataatggtaaaatttccgcatccgtcagcggtttcactgaatatacgattgcgtcttctgtttgacgggcctcatttgcgagtttgataaactcatctgtgagctcaggcacaatcgcggcacgatggcggtcaatcaaaagaaaaatcgtattaagcacggactgtgacaaagagccaaatgcattttggatcagctcttttttcttcgcagccggcaccttcggatggttcaacacatcattaagcgctttttcattttgaaatacttgtttcacaacagttagctcttcttctacttgattcagctgagcggactcattggctatatcaaaaagagctgatgcatatcgtttagagacagctgatccactcatcggctttctcctacctctttaagatagtcctggatcaatttctcttgagcttgttcatccagttctttttcgatcactttcgacgcaatcatgacagaaagagacgctacttgctcacggagagcagaaaccgcctgttctttttccttcacgatttcagttcttgctgcttctttcagacgttcagattctgcacgtgcagcctgaataatctcttctttttgcttctctcccagtttctttgcgttttcgataagagtttgggattcctgtcttgcttcttttaaaagaacgcgctgctcttcaatcagctgctgcgcctctttatttttttcttcagcagacgtaatttctccagcgatgtggtcttcacgctgtttcattatgtttaatagcggccctaaagcgtatttcttcagaagcgctaataagattaacatagctaacagttggaacaggatatctccgccgttaaacgacaatcctagttcaagtggtaattgagacatctactacggcaactcccttctgcaggtttttctttgctgatccagcagccgcacttgtctcttttcagccggcaaggcggggtgcttatcagacataaagcaatggcgaaggttctcttggaatgatcttcgccatttttagttcatataaggcttttatgcttagccaaagaacgctaagaatgcgataacgacagcgataataggaagggcttcaactaatgcgatacccatgaacataagagttctcagttctttacctgcttccggctgacgggcaatcccctctaccgtacgtgaaacaatcaaaccgttaccaatacctgcaccaagtgcgcctaaaccaattgcaatcgcagctgctattaaattcatgaaaaagttcctcctttaaaatgttatccgtttggatataatgttttaatgatcatgactgattttatgagacatgtacaccatcgtcagcattgtaaagataaatgcctggatagcaccaataaataaactgaatgcttgccatgccagcatcggcagaatggcaccgattgtaccgacaagaccgagagccacgctttgcgaataatggcttgttgctaatcccgcaagcaggccgagaagaatctcaccggcgaagatgttaccatacagccgcaaacctagagtcagcgtattcgcaaactcttcgatgattttcatcgggagcatgaatggaacaggtcttaaatagtctttggaatattccttgagccctttcatcttcacaccatagtagtgggttaaagcaacaaccatcacggctagcgttaatgtaatggcaggatcggctgtcggagacttccaccagagctcatgtccgattgtaatagagaacggcagccccagcatattcgacacaaatatgtacatcagcaatgtgacaccaagtgccaagaagttagcccctgtttttaaatccattgtactgccaataatattgcggacgaaatcaacaatccattccataaagttctgggcttttccgggacggatcgaaagcgttcttgtcgtcaatatagcaatcaataaaacaatcacactcgccacagtaatcatcagaatgtttgtcagattaaaagtaagacctagaaattctatagttctgtaaccatgattcaaagggttttcacctctcttccattgatgaacgtttaagctggataaaggaatctatcataatgacagggtatattgtcattaatccaataactgtacttgccatatgaaaatattcgggatttttataggcaacagccacagcaagaatcgcattgcaccaccgcgctgcgctcccgagagatcgtatggactttcctttctcaacagctctgtcaaaagcattcattcttctgacgagcagtaaaaaattaaacaaactgaaaacagttcccagaataaggcctaaaaaaacggtattatacgctgttaaaccataacccagtacatacactgccaaaatgaacaataaatatttgcgttgtctgctaaatgtaagcttgggatcgtccatcaattatctgtctcctgatgaaaaaataatgtatagcttggatacggcaaaaatcagcggttaacccttagtagaagaccttttttgaccggcaaaacgggcctgttcgaaaaaatcattcatccgcaagccttgcagggatgctgtttcattcgcttaaataaatcctcataatacgggtttgctgagaggatttacattgaggatgaggactataatgaaagctatgaaaaccttctcataataccctcgtttagcatacaatagcccctaacatgtgtcaatctgtttaaagttaaaaaactttttatactttacgtctccacagaatgttcacattttcacctataattgtatacagattcaccgaatagcaaataactggataaaaaaatgaaacccccttttggggatttcattttttattttgttccaaacatgcggtcacccgcatctccgagacctggaacaatataacctttttcatttaatttttcatctaacgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcccgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatctcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagcccaagcgggttttaggatcttaataatctaattctttatataaaggaaatttatcagtcagagcagctacacgctgtcttgcttcttcaagttttccttcgtcttcgtggtttttcaatgcaagcgcaatgatagcaccgacttcttctaaagcgtctccgtcaaaaccgcggctagttacagcagctgtaccaagacggatgccgcttgttacgaaaggtttttcaggatcatatggaatcgcgtttttgttagacgtaataccgatttcatcaagtacatgctccgcaaccttaccagtcagtccgagcgaacgaaggtcaacaaggataaggtggttgtctgttccgcctgaaacgagctggatgccctctttcgttaaggcttcagccagacgtttcgcgtttgaaatgacgttttgtgcatatgttttgaaatcgtcctgcaatacttcaccgaatgaaacagcttttgcggcaataacgtgcatcagcgggccgccttgaattccagggaagatcgatttatcaattttcttgccaaactcttcacggcaaaggatcataccgccgcgaggaccgcgaagtgttttatgtgttgttgttgtaacgaaatcagcgtaaggaaccgggtttggatgaaggcctgccgcaacaagtcctgcgatatgtgccatatccaccatgaagtaagcgccgacttcatcagcaatttcacggaatttcttaaagtcgattgtacgaggatacgcacttgctcctgctacgataagcttcggtttatgagcgagggctttttcacgcacgtcatcgtaatcaatatattgagtttctttatctacgccgtactcaacaaagttatattgaacaccgctgaagttgactgggcttccgtgtgttaaatggccgccgtgggagaggttcatcccaagtacagtatcgccttgctccaaaatcgtgaagtacacggccatgtttgcttgtgcgcctgaatgaggctgaacgtttacatgctccgctccaaagatttccttcgcgcggtcacgggcgatatcttcaacgacatcgacgtgctcgcatccgccgtagtagcgtttgcccggatatccttctgcgtacttatttgtcaaaacagatccttgtgcttccataaccgcttcacttacaaagttctcagaagcaatcaattcgatcttagtctgttggcgttcacgctcatttttaatggcgttaaacacttgttcgtcttgcgcaggtaaatgtttcatcagcgagatcctctcctatccgtatcctgttctttgtttttaccatcactattgtacatggtttttaaggccgatgtaaaagattatttttaaaaaatctaaatttttattggtaaaaacgaatattaataacttaaatttaatttaaagttcggaatttatttcactgtcttaaaataaaagaaaagactggctatgcagtcctttcattcgcactcataaaccgcccgcactccgccgattagtttcggccgtgtacgcgccaatgtcacatgagctgaaccgaggctgttttgagagacacgcacagggacagccaccggcttcagatgcatgccgataaacgtatcgcctatatcaattccggcgtcagcctgaatggtttcaacaagaacaggagacttcatctgcttaaacgcataagacgccatcgcgccgcccgcttttggaacgggcacggcagaaacggttggaagcctgaacagcttggctgtttctgcttcgacgacaagcgctctgtttaaatgctcgcagcattgaaacgccagatggattcccgttttttcccggagctcagcaagtccgctgtagatgctttcagcgatatctacactgcccgatgtgccgatccggctgccggccacttcgctcgtgctgcatccaaggacgaagagctgatcttgtttcaattccgcttggtcctgaaactcagacagcatcgtcttccacgtttgtttcaactcattcattaaacagcacccctacaggtttttctcttcataatctgagatttttccaatacgcgtttggtgtcttcccccggtaaactcagtagtcagccagatttttgcgatttcccgagccaaaccaggtccgatcacccgttcacccatcgcaaggatgtttgtgtcattatgctccctcgtcgccttcgcgctgaaggtatcgtgcgccagcgcgcagcgaatcccttttactttattagcggaaatgctcatgccgatgcctgtcccgcaaattaaaatgcctctgtcaacttcgccgctaaccactttttcggccaccggaaaagcataatccggataatcgacagagccgctgccgcagtcacagcccatatcaatatattcaatttgcaattcgtccattaactctttgatttcatttcgaatgtgaacgccgccatgatccgatgcaatggctactttcatctgcttttcctcccagcgtgtgtgatgcggcccgcccgctttattgaccgcgcagcctgtccgctctttgattcacaccatatgatgtgcttttcactatattctactccttcacgcaggatttgcaaatgacctgtttgcagattttctgacaacttatctgcggtcttttttcagctgttttgccagctgctgaagaagctcttcaagctcatctcgcgtttgtttatagatgtcaattgagccgccgaacggatcgatgacatcaccatggctgcctgtgacatattcttttaacgtaaacactttatcacgataacgtccaaattggctggcaatgatctgcttgtgctgatgggtcatagccagaaccaaatcagccgactccatatgttcttcagttaatggagaagacacatgattaagggcaatatgtttttcaaacagcgcttcgactgcatgaggcgtcgctttcccattaggtgaagcaaacacacctgccgagcggacattgacattcagcccttccatttctgcaattgatttaaaaagcgcctcagccattgggctgcggcacgtatttccagtacagacaaaaataatatccatgtcagtcaccccttatttttctctattatatatgaagaaaaaagaaacggcgacttcgtttcttttattggtatattaaattggcaaaagcagctttaatccaaacacgattaatatgatgccccgagcgcttcgctgtatgtgccaagccatgactgcacttgttttccgaccagcaggcccagccatgtcaacatcatgctgaacagcccgaacagggtaattgtgaggagcggatgcgagccgtatatccccaagctcaagccgacggaaaagctgtcaaggctgacgccgatggcaaacagcaataagcccggccctgccggtgacatgaatcgttcttctgactgtttaaaagaggccataagcatttgaaccccaagaacaaaaagcagcgccccaccgatataaaccgctaacacgccgaggagccctgacagcatgttaccggccgccatccctgcgagaggcatgatgacgtgaaagaggccgatgatgaaaccaatatagaatatctgcttctttctaagtttgaccatgcccattccaaggccgacagaaaaagcatccatccctaaagcaaacgccatgatgcttaatgtaatcagttcgcctataaacaaatccgacatacataaataacccccttggacacgccccgcttttttagcctatgcgtgtccaaaaagggttagaacatctgactgctttcagcgaatcactcttcctccggcggctttcatcagcctgttcataatagccagaccgacacctgtgtccggaaaggattccgcaataatgaaatctaccttattgtcatcaaagctgcgcaaagcatcatacagccctgccgcaacagtctcaagctgagcccgtcttccgcagctcttcacataatcagcggaataaacgcccgcgttttcttctgtcgtcaggataccgacccttcttccgccctgttgatattcttgaatgaggtgctgaatgcgctctgggctgccttcgcaaatggcaagcggcgctgtcggcgcataatgtgtatatttcatccctggagaaatcggcttctcgttttgatcgctgagccctttatccacatggatcggcccgatcaccgcttcaatttgttccttcgtaatgccgcccggacgcaggagaacagggatgtcgtccgcacatgaaagcacggttgattcgaccccgattccggtagggcctccatccataataccggctatgcggccatccaagtcgtgagccacatgctccgcttttgtgggacttggcttgcctgatagattggcgctcggtgctgcaatcggcagtcccgattcgcgaatcaatgcaagagcaagcggatgatccggcattctaatggcaaccgtttcaagacctgccgttacacgaggtgaaagcgcatcaggtttgcaaggcagaatgagcgtaagtgctcccggccaaaaccgtttcatcaatgttttcgccttttccggcgctgggcccgttaaatcctcaagctggctgatatccgcaatgtggacaatcaggggattatcgctcggccttcctttcgcctcatatatttttttgacggcatccgtattttttgcgtttgcgcctaggccatatactgtttctgtcggaaaggcaacgacctcattttctcggagcaaagcggctgcttgtgcaatttgtggatcatttgtggataactcgtcagttacatccacaaaccatcttttcgttttcatttctgaccaaactccttattcacaacaataaaacgattgttttacgcgtgtaattcttttgaaagtataaaagatgtcctgtaataaaacaagcgttatccacaaattgtggacaacgctaataaagaagtggataagtatgtgtataaactgcacttatccagacgcttttttcatcaaaacggctccttctgtttgccgcgattcacagaagtgatcagaagaaaacagctcctccggtacactatcagctctttcaaaacccatggccgtcagaaaatccgcagaggaatgctgatttgctactaggtacacggttttgatctgatgcttttcgcacagcacctccatgctttgaaaaagcgtgacgatatggccttggtgaagcttgtccgatatgacaagtgatcgcagcagcccctggtcacagcttattttttcaataccgaggcatccggcaatgtttttctcactgtcctccagcataagaaattgagtgaagccttctttcacaccttcatagctggttttcgcctgttttaaaaatgcctcgagcacatctccgtctttttcccttgccacccgcagttgataaaacatccgttcaccccgtttttgcgttctttcttccaatctatgaggcaaatctatttttagaccagatgattaggaaaaaaggtcggaaatccattcgactaaaaagaatttcacttctgtgccgtcttctttctcttcgttctcttcttttttggctttttccgctttagcggttacgtcctcaagcactttttcagtctgcttttttgaggcttctttatcttcttgttctttgacggcttccccgttagaaaaatcgagaaagcagaggggcgggaacagcacacaccaccagttggcgccgtctccgtttccaagcgtaatcaaaatcgcttcatactcaccggcaggatataccatgttgccgtaaagctttgtcggaaacgagattttgtcaaaatcaacggatatcgactgattcgctccttctttctccattgtttcctttgcaattgctttgatttcaggcagctttgaacgaatcacgcgacgcgcttcttcaatagaagtaatatcctttacccaagttgtgatttctttattcaccgcgtctcttatatgacgttttaattgctggtcttggtcactatcgctgtttgccaatattctcagacgaatcgcctgatccggtatgaccaccggctgattttccgatttctgtgccgtctcttcttttgccagccctacgagcgctccagatagtaaaagaaagatatatatacaaatgattactgtttttttcatcggtccccaccgttcctctccgtgctttgtttctagccctattatggacaaggagagccgggggtaaacgtgcagggtgaaaaaaatctagcaagctgttaatcttatttatggtacgatagtgttttaggaggtttaagatgaaatacaattatacagtgctgttatcagcattcacgatgtccgttctttattcagtaatttatattcattcatttatcattgccgctctcatcacaatggcattttattttctgtttccttatttgatcttcgcactgccgcttcaaatcatggtgaataaaaagccgaaacggttcagccctttgtatctgctgtattaccttgccgctgcttttattgccaacgcgatcattttcggcgtgcttcagccttcgggacaatctctgtttcaaaatacagccttttatcttttcgctgtattaacagctcttatctattggatatgggattctgttttactgcaaaaaaaggaagcctaagaggcttccttttttattaaaacaaaatcgtcagcaaataacatagaatggaaggtatcgccgcaacaaagaaagcggccgccattttcatgcgagatgtacggctttctttggtttctgaatggtagtttgcccgctgatcgcttccgcttacagccaaacccgatgtaatgatcgcgagccccactaaaacgagagacgcaacgccaaaaatcgcttcatatgaaagagcctgcggaaaaatggtgccaatcatgctctcaatcgcaatgagcaggattcctgctgtcagggcctttttcatgtttacatcccctttgctggtgttaaacagcttgatccattcactcgccagcaagctgcttatttatttttatgaatcagagcgcatatggttctgtcttttccattaatatctttcagcacttccacttccgctcccttaaacgccttgaggatcaggtctttgaccgccgctccctggttccatccgatttcaaaaacgacaaatactttatccttcatgacaagcggaatgtcttccataaaccgcttataaaatttcagcccgtctccgccatcggtgagagcgtgcagcggctcatgaaaacggacaatttccgatagatcagccatttcttcctctgaaatatatggcgggtttgagacaatgatatccgctttttttcccgccttaataaaaggctcaagcagatcgccctgataaaagcgcacattcgctccgagtttttctgcattggcagaggcgacttgcagcgcctctttcgaaatatcgaccgccgacacagaaaagctttggttttcaagcgcaagcgtgacggctattgcgccgctccctgtaccaacgtcaacaacttcgagtttgccgtcttcagaaaagacactccgatatttttcaagcaaatgaaagacaacttcttcagtttccggccgcgggatcagcacatcatcattcaccataaattcccgtccataaaaaaactcttttcctataatgtattgaaccggcacgccctctttatgcatctcaacgtgacgcttaaagcgatacagttcgtcttcaccaatcggttcctgtaagcttgcgagcagtttgcttctctccattccggtatcataaagcaataggagctcggccgcattttcttctcttcccgcttcggttaaataagaagaagcccatttcagggcttcgaatatcgtcttcatcttaaccttccgactgctgaagcttgcttgcctgatcttcaacaatcagcgcttcaaccacttcgtcaagttttccttcaagaatctgatcaagcttttgaatcgtcaaaccgattctgtgatccgtcacacggttttgcgggaagttgtatgtgcggatacgttcagagcggtcgcctgatccgactgctgatttccgtgtttgatcatattcagcctgggcttcctgctgaaatttatcatagattctggcacggagaaccttcattgctttttctttgttcttaatttgagatttttcgtcttggcatgatacaacaacacctgtcggcaagtgagtcagacgaaccgcagacattgttgtgttaacgctttgtccgcccggtccgcttgaagcaaacgtatcgacacggatatccttctcatggatgtcaacctctacctcttctgcctcaggaagacatgccactgttgcagtggatgtatggatacggccgccggattccgtttccggaacacgctgcacgcggtgggcgccgttttcatatttgagtttagaatacgcgccgcttcctgtaatcataaagatgatctctttgtagccgcccgttccggttacattcgcttccatgacctctgttttccagccttgaagctcagcataacgggaatacattctgtacaggttgcccgcgaataaagcggcttcctcgcctcccgcagccccgcggatctccatgataacgtttttgtcgtcattaggatctttcgggatcaggagcaccttcaggcgttcggacagtgtttccgtttccttctgaagttcagaaatctcttccttcaccatgtcgcgcatctcagcgtccagcttctcttcaagcatcgcttttgcatcagccagctgttctgacgcatctctgtattgtctatatacgtcaactgtttcttgtatatcagattgctcttttgaatattctcttagctttttcggatcgttgactacttctggatcgctcaaaagctcatttaatttctcgtatcgttcttcaattgattttaaacggtctaacacggtcttcacctctgttttcctgtgcgtaacattctcattatagtatagtgattaaccccagtcaaaagcatttcaatcccagctggaaaagctccctctgctatactggaattcgaggagggatgatgttgctgaaatccatacatcatattgcaatcatatgttcagattacgaaaagtcgaaagctttctacgtacataagcttggttttcaggtgattcaagaaacgtaccgcgaagagcgcggctcctataagcttgatttgtcgcttaacggctcgtatgtcattgagctgttctcgtttcccgatccgcccgaacgacaaacccggcctgaagccgcaggcctgcgtcacctcgcctttacagtcgtcagcttggataaggcggttcaggagcttcatgaaaaaggaatcgaaacagagccaatcagaacagatccgctgaccggcaagcgtttcaccttcttttttgatcctgaccagcttccattagaactgtatgaacaataacagtttttgaagaaaaaaaggagatacccactttctttgccgaatcttttcttgttttgtctaacgggaagggaaccgcattctatggtcgaatacctagcttaaaaggaggtatgggatcatgaatacaaatatggtagcaagtgaactcggcgtctccgcaaaaacggtgcagcggtgggtgaagcagctgaatcttccggccgaacgcaatgagctcggacactattcgttcacggcagaagacgtgaaggttctaaaatccgttcaaaaacaaatctctgaaggcacggcgattcaggatattcatctgccaaaaagcgctaaaaagcgcacaggcttccttgtccaaaaaacaagtagcgacacagaacgaagaatcgagcagcttgaacaaaagctggacacccttttacagcaaaggcaggacgaaagcgaattgatggcaaggatgtcggagctggaacgccagctgaaacaaaaagccgatgaaggtgtatcttaccagctgcttcagcaccgcagagaaatcgatgatattcttgcagatctgcaatcactgacctcacaaatgaaagaattcaccgctcagccgatccccgagaccgctgctgcttctgaaaaaaccaaaacgagaaaaaaaccgctgctgtcactgttcaaatttcaaacctaaagcaaaaagctcccgtaaagggagctttttttgttacgcagtaagcgcgataatgattggaagtgaaatcaatgacagaatcgcactgaccacaaacgcagttgcagtttcttcttcttgtttctcgaaacgagtcgcaatcatggctgcaacggcagaaccagggaatgcaacaagaagaattgcttttgttgtttggtcagccggaagtccgatagcaagagcaatcaagaacattaacgcaggctgaaccgcaacttttagtaacgcaataccgatagccggcatactgagtttaattttacgaataccaacggtaacaccgacagcaaagagagcaacaccagatgttgtgcttccaagctgatcaagcattttaacacccagctcaggaagagtgaaattgaaaaccagcactaagatcatactgattaacggagcagctgcaagcggctcacaaagaccatgcaggattgattttcctgtcatcttccagaagctgtcgccactctcttcgtttttcttagaagactcaccaacagtagcgataatgatcgcgagcggatcaagaatcgcgttaaccacgatacctgtgaccgcgatcggaatcgcaacttcattcgctccgaataagcttcccaataccgggatacccataaatgcgaatgtcggctgtgcagagttcaaagaaaatacagatgagttcgttaaatcatacttgaaaataaatctgcaaaccaaaagaatgatgatatagaaaccaacaatcccaataattaaagaaatcattaaaggtacttgtgataaaaattcacttctggaagttgtcaaaataccagcgataaagtgagctggaagtgcgtatttcgttactaacgtacttaccccttttgccgacttggcatcataacttccaaaatgtcctgcaaaccaacccagcacgataacaaagaagatcggcgccaggaggattaagatatctaagatgctcaaaatattctcctccaaatcctatgtccgtatactttagctttacaaaaagctttccctcggacagaaaaatttactcgctaattatttcgcgatgacttttttgtattcaggtgtccacattgcatcaagtaccgcttgtttcacatcttcaggctgacgatttgccacgccgtctttaattgctgcttcagcaacggcaatcgcaacttggatagaaacctcttgaagcttatcaatgcttggaagcaatcctgctccaggtgtttcaagatcaaccatttcagcaatcgcatcagcagttgctgcaaacatagcaggtgtaatgatacgcgcttcagctacaattgaaccaagtccaagaccagggaacgcgaatgcgttgttagattgtccgatttcataagaaacaccgttgtattctacattgtcaaatgggcttcctgttgcaataagcacttttccgtcagtccatttgaacagatcttcaggaacagcttcagcaaggtgagtcgggttagacatcggcatgataaccggacggtctacgtgagatgccatttcttttacaatttcctctgtgaatgcacctgaaaccccagaagtaccaatcaagatcgttggtttcgcttgacgaaccacttcatcgaatggaatttgacctttttcatcgcgcttccagtctttcacttcatccgcattgcgaaggtaaggtttttggaaatcaaggatgccttcgatgtcttcagtcagcaagcctctgtaatcaagtgtgtagaaacgtttgttagcttcttcttcagataatccggcaagcaccattgtgtcacggatttggtcagcaataccgataccagcagaaccagcaccgaagataacaacacgctgatctttaatagaagcgccggttttcttcatagcggcaagcacacctgcaagtgtaatcgcgccagtaccttgaatatcatcattaaatgtcaggatttcatgattgtattttttcatgatgttgcgtgcatttttgttgccaaggtcttcccagtgaagaagcgctttagggaagaatttcaatgcagcttttacataagcgtcaatgaaagcttcgtagcgttcaccttgaacacgttcatgcttgttaccaatatataaaggatcgtttagaagtttttcgttgttcgtaccgacatcaagcacaaccgggataacacggctagggtcaataccagctgcagcagtgtaaacagccaatttaccgattgcgatattaataccgcctacaccccagtcaccgataccgagaatgctttcggagtcagtagcaacgataagatcaatatcgcctgctgtcgcatgaaggttttcaaacgctttttcaataccgtcaatgttgtcgattgacaagtagattccttgaggtcttctatattcatggctgtattcctgaatcgcttcaccaactgttggcgtgtacacaacaggaagcatttcgcgaagatggtttttcagcaatttatagaaaagaacttcgttacggtttgcaagatcacttaagtaaacattttgacgaaggcggtcaggctgcgcttggaattgctcgtacgcgcgttgtgcttgttgatcaagagaaagtacagttggcggcagaagcccttctaagccgagttcttgtctttcttctagcgaaaaagcaacgcctttatttaaagtaggaatagataaaacttcttttcctctaagagttgtttctaagtggccttctttcgttttttttatgttattcaagcaaatctccttctttcttgaaatagttaaccaagttaagtaataacccatctaaaatatgaccgatcatgatctttatgcgactttatgacaattattcgaacaatgtctcaaaactatttacattacgtaagctattgtatgcctgtcaaaatcaaaattcaagggaagaaaattacttaattttttaatatacttatttaaattttttaattgcatattatcagaatataaaaaaaacaccggtgtttttagccggtgcattctatctttatacccatgttttggactattttttagatttacctgggacttcgtgatgatgtctgcatcttgcttcatatgattcagatgcaccaaccaaaatgaccggatcatcgtaagaagcaggtttgccgtcaatgaggcgctgtgttctgctcgccggtgatccgcaaacagaacagacggcttgcagctttgtcacactttccgcaatcgccatgatattcgggacgacaccgaacggctctcccctaaaatccatatcaaggcctgctgctatcacacggtagcctttatcggcaagagatgataaaacctcaacaatttccttatcaaaaaactgcacttcatcaaccgcaaccacatctgtactttcactgatgtgatcccaaatgtccgcagcagacgaaatggcatagctcgtcatcgatgttccattatgggagacaacagcagcttcgctgtatcggttatcaattacaggcttaaataccctgacttcctgcttggcgtaagtcgctctcttcactcttctgatcagctcttcagatttccccgagaacatgctgccgcaaatcagctcaagccacccgctttgtttcattatgtacataggcttcgctcccctctctctgccagctgtgttttagacaatataaaaaacaggcaagactgctgcttgcctgttgagaaatctattattacttaagaccgtattttttgttaaagcgatcaacacgaccatcagcagaagcgaatttttgacggccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattatttcggagcattgtccgaaacgcatatgagaaaattatatcagtgatttacttcttttgcaaatacaatttaccttctagcagatgatagatttgcctgtttccattcttgattgagaatatcgaaaaattcctggtttgttttggtttttttcatttttctcatgaacttttctgcgaaatcaggtgaatcagacatcgttttgcggatagaccataaacgatcaagatgctctttaggcacaagcagctcttctttgcgcgttcctgaacggcgaatatcgatggcagggaagatgcggcgctcggcaagagagcggtcaagatggagctccatgttgcctgttcccttgaattcttcataaatgacatcatccatacgtgaacctgtatcgaccagagccgtagcaaggatggttaagctgccgccctcttcgatatttctcgcagccccgaagaagcgtttcggacggtggaacgccgctgggtcaatcccccggaaagcgttcttccacttggcggaatcactaagttgtaggcgcgggcaagccgtgtgatgctgtccatcaggataatgacgtcttttttgtgttccacgagacgcatcgcacgttcaagcacaagttcggccactttgatatggttttccggcacttcatcaaacgttgagctgacgacatccccagctacagagcgctcgatatcggttacttcctcaggtctttcgtcaattaaaagcacgatcagctctgcttcaggctggttcgctgtaatgctgttggcaatttccttcagcagcatcgtttttccggctttcggcggcgcaacaatcaatccgcgctgcccaaatccaaccggcgccatcatgtccataattcttgtagacaagaagttcggctttgtttcaagcaccatttgacgatccggataaagtggcgtaagagccgggaaatgcacacgctcttttgcagattcgggatcatccccatttactgcttcaacgtgcaaaagtccatagtaacgctcattttcttttggcgggcgaaccttgcctgatactttgtctccgttccgcaaatcgaaacggcggatttgtgaagctgagatgtaaatgtcttctgagcttggagagtagttgatcggtctcaggaagccgaaaccttcagactggatgatctcaagaacaccttccataaacagcagatcttcctgttctgcattcgctttcagaatggcgaaaatgagttctttttttgtcagtttgctgtaataggagattttataatgtcttgcaagttcataaagctctttcaatttcatattttccaaagaggaaatagatacgtctttcataaaaacaccacgcttttcatagtcaatatcttactctgaacatatcatctgctgcttttgcacaacatccgccaaagcacattctttttttaacataaaggaacttctatcggtaacacttccacccatgatcggcgcttttgttaaaaggattgtcttaatgagttttgaaggaagcgaggacaaaaacatgagaagatcaatacttatatcgtctgtatgcggtagaaattgaaactttcctagtgcttaaaagaaggtattacgcagtaaaattcgcagcactctttatttttaccttatttcaaaaaattattcaactgaaataaggttttgacacggaattgatagagttgacgcttttctgcaaaagttaaagcgggctcacacccgctttttctgtttgttatggacggattacaagatttggtttctttttcaagctgtgtctgccgtcaacgaaacgaacagtgcccgattttgcacggataactaagctttcagttgtaccgacagagcctttgaattgaactccttttaacagctcgccgtcagtaacccctgtagctgcaaaaatcgcgtcatcacccttcacaaggtcttccatgcgaaggactttgcttaaatcaaggcccattttgtgacagcgagtgatttcttcttcgctttgcggaagaagtttaccaatgatttctccgccgagtgcttttagcgcaacagcggaaagcacaccctcaggagcgccgcctgatccgaacaggatatcaacgcccgtgtggtcgaaagccgtgttgatggcgcctgcgacatcgccgtcattgatcaatttgattctggcgccggcctcacgaagctcggaaatgatttttgcgtgtctttcacggtttaaaattgtggcaacgacgtcctcaacgtccttgtttttcgcttttgccaccgctttaaggttgtcaatgacaggtgcttcgatgtcaatgcagcccaccgcttccggaccgactgcgattttttgcatatacatgtcaggagcattcagaagcgtgccgtggtctgcgaccgcgataaccgtcagcgcattccagccgccgcttgctaagatgtttgtgccttcaagagggtcaactgcgacatccacgcgcgggccgtacccgtttccgagtttttccccgatatacagcattggcgcttcgtccatttccccttcaccgattacaacagtccctttcatcggcactgtatcaaaaacgtctctcattgcacttgttgccgcttcatcagcctcatctttttttccccggcccatccatcttgctgatgccaatgccgcagcttcggtcacacgtaccaattccattgataaacttctttccatttcaacacgatctcctctcacaagaaaccattatgaattttgaagctgttctatttcttcgtcagtcattctttcacgccaaattgtcgctccaagcccctcaagcttcttctcaaggctgctgtatccgcggtcaatatgctccagtcccgtaatttccgtgacgccatcagccatcagtccggctaccaccaagcaggctccggcacgcagatcactcgccttcacttttgcgccttgaagctcgacaggacctgtgatgatggcagatctgccttctactttcatattggcacccattcgtctcagctcatcaatgtgcttgaatcttgccgagtagatggtgtctgtgacgacactcgtccctttcgcccttgtcaggagcgccgtcatcggctgctgtaaatcagtcggaaaccccgggtatacgagggttttaacgtcaaccggctttaagttcttctgcccgccgacaatgaggagctggtcgtcacttgtttcgatatgatagcccatttctctcaactttgccgttaacgactctagatgagtgggaatgacgttatcgataatgacttccttgcccattgcagcccctgcaatcataaatgtcccggcctcaattctgtccggaatgatcgtatgcttgcagccgtgcagttccttcacgccgtcgattcgaatcacattggtgcccgcacctttgattttggcgcccatgctggtaagcaatgtcgcgacgtcaatgatctcaggctccttggcagcgttttcgatgatcgttttcccttctgccaaaacagcggcgagcataatgttaatcgttgccccaacgcttacgacatctaaataaatccgtgcgcctctcagcctttcagctcgcaaataaatggcgccttgttcattggttacttcagctccgagtgcttcaaagcctttgatatgctgatcaatcggacggggccctaagtgacagccgccaggcaatccaatgaccgcctgcttgaagcggccgagcatcgcccccattaaataatatgacgcgcgaagcttttttactttcccgttaggaagcggcatgctgatcatcgacgtagggtcaacaaccatttccccattctcaaaatgcacgttgccgccgatttcctttaacaggtcacgcagcgtttcaatatctgaaatctctggaagcccttcaattgtcacctcggaatttgccaaaatggttgcaggtattaacgcaacagcgctgtttttagcgccgctgatatgtactgtaccgtttaacgagtcaccgccggcaatattcaacttttccatgatagtctccttccataagaagatagctgcggagctaaataaaatgtcattttattctgtctctgcaaataaagctcatgtccaaaatctagccaattcgaagagaaagaatacaacacattgtaaaatatcaggaagaaaatagcgaagctttgggggtacaggtttcaaaagatgcacagagacccgccggctcgagagacatcgtcgtcatccggcaaaagcagtacgcatacccttcattccgatatcagcttctgcagcccaatgattccttctctgtaaagcggcgtcagcatctgaagatccgctgtatcaggtcggtgaaatacaaaggccgcggcaaacaggcataaagctgtttgccgcccctttcattatttgttccagtctgccaggaattgttcgattcctttgtctgttaacgggtgtttagtgagcgcatgaatgactttcagcggcattgtgccgatatgagcccctctaagagcagcttctgtcacgtgctgcgggtggcggattgacgctgcaatgatttgcgtgtcaaggccgtgaatgtcaaaaatctgtttaacttctgaaatcaggtcaagcccgttgtggccgatgtcatctaaacgtcccaggaatggagatacatatgttgcccccgctctggcagcaagaagcgcctggtttgcattgaagatcaatgtgacgtttgttttgatgcctaagtcagtaagtgctcttaccgcttttaaaccgtcagacgtcatcgggattttcaccgtaatgttcggtgcgattttcgccagttcttttccttcctcgatcatttcctcagctttcaaagaaataacctctgcacttacagagcctttcacgacgtctgtgatctcgcgaagacggtcgtggaatgatacattagcttcctttgctactaaactaggattcgtcgttacaccggcgagaattcctaattcattcgcttctctaatttcatcgatattggctgtatcaacaaagaataacattttcaaaaagcctccctgattaagaaattttctgaactgcgaatatgattgcgctttctaaagatagacggaaaaccgcctgtcaagctgtcaggcggctataaaaagttccaattgaattaagcttggtttgaagaaccaaattcacgcattttaccgataactgtttctttgatcgcttcacgagctggtccaaggtatttacgtggatcgtactcgtcaggcttagctgccaatgtttcgcgaacagcttttgcagaagaaatttggttttcagtattcacgttgattttagctgtaccaagtgaaattgattttttgatgtcagcagtcggaattccagtaccgccgtgaagaactaatggaagaccagttgattttccgatctcttccatttctttgaagccaaggtttggctcacctttgtaagggccgtgaacagaacctaatgcaggtgcaaggcagtcgatgccagtgcgctcaacaagctcttggcactctttagggtcagcgtagattacgccttcagcgataacgtcatcttcttgtccgcctactgttccaagctcagcttctacagatactccgtggaaatgagcaagctcaacaactttagcagttgttgctacgttttcttcaaatggatggtgagaagcgtcgatcattacagatgtgaaacctgcatgaatcgctttcgcacaagattcaaagcttgaaccgtggtctaagtgaatcgcaacaggaactgtcactttgtactcttccataagtgcttttaccatagcaacgactgttttgaagccgcccatgtagcgtcccgcaccttcggaaacaccaaggatcactggagatttttcttcttcagctgcttgtaaaatcgcttgagtaaactcaaggttgtttaagttaaattgtcctacagcataccctttttctttagctgtattcaacatttccgtcatagaaactaaaggcatgtcgaatgtcctccttatgtagcctgattgtcttctagcgaaaaaagctttccaccctagcatgacccatatattgctgtcatatgtaaatactcagatcgctttttctccataactaggataccaacttttcgacaaatcggcaacacaatgacaccattcatttgtttcttctttttgtcagttcgacttcaggggcagatattttttgacggcgtctctgatttcgtcgatgtcaaacggcttggcaaagtgcgtcagagcgcccaattccttcgattcctggatcatgtcgagctctccgtatgccgtcatgataatgacccggatgttttcgtcaatgaccttcatccgttttaagatttcgattccgtccatgccgggaattttcatgtccaaaagcacaagatcgggccgttcttttgtcacaatgtcaagcgcctgcaggccgttcgcagcctgaaacgtctggtagccttctttattgaacacttcatttagcaaaatacgaatgccgtattgatcatcaacgattaaaattttttcattcatcattttacaccccaatattatgattttcgtcaaaagtaagcagtattgtatgtattctgtttgattttcctatttcctttaattataatagtctactttacgacattttctgagcattttctcttttgttgtatactgatattgtacgttataaaggaggattcacttatgttgaaaatattcacgacgcagttaacaggtattttttcccgcattcaggataaggaatctgacgcgattgaagatggggcgcggctgcttgctcaagcggtaatcagcgggcattccatttatttatacggagcgaatgagcttcagggcgtcttttttgaggccactgaaagcaaagaacccttcccatctgtcaaagcctttccagaaagcgctgaggaagtgacagaaagcgacagggtgctgatgttttgctcagggacgggcacagccgaagaacaggcgctcgcaaaagagctttatgaaaaaggggcgggagtcgtatgcgtatcacccgcagccaaagacagtgcgggaatagaacagtattgtgatgtgcatattgattctaaattaaaaatgccgcttgttcccgatgaagacggcacccgttacgggtttccctctttaatgacagcactgtatgtctatcacgctttatcgtttacactaaaagaaattctgcaagagtatgcataatatcttattgtacatgctggaacttgccggaaacaaataaaaaagacttgcccgcttttgacaaacggcaagtcttttttattacttctgatttgcagcttcgacagacgctccgataaagcctttgaatagaggctgaggtcttgtcggtcttgacttgaactctgggtggaactgagaagccacgaaccaagggtggtctttcagctcgatgatttccacaaggcgtccatcagggcttgtgcctgagaatacgaagccttgttcttccatttgctgtctgaattcattgttaaactcatagcggtggcggtggcgctcgtacaccacttcgtcctgatacacttcaaaggctttcgtgccttcttcaagcttacaagggtaaaggccgagacgaagcgttcctccgagatcctccacatccttttgttcaggaagaagatcaatgatcgggtattgagttgacggatcaatttctgctgagtgagcgccttttaagcccaatacgtttcgtgcgtattcaatagatgccacctgcatgcccaagcaaatgcccaagaacggaatgttgttttcgcgtgcgtattttgtcgcgacgattttgccttcaacaccgcggtctccgaatccgcccggcacaatgatgccgtctgttccgcttgtgagttctgcgatattattttctgtcacttcttccgcgttgatccacttcacttttacatctgtgtcaaacgcatagcccgcatggcggagagactcgacaacagaaatgtatgcgtcaggaagctcaacgtatttgccgacaaggccgattgtaatcgtttgagacaggttgctgactttgttaacaagctctttccactcggacatttccgcttctttgcatgccaatttcatgtgctcgcaaacaagcttatcaagcccttgtttttgaagctccagcggaatggagtaaaggttgtccgcatcttcacattcaataaccgcttttgtatcgatgtcgcagaaaagcgcgattttatctttcatatcttgagaaatcggcatttctgtacgaacgacgatgatgtttggctgaatgcccaagctgcgcaattcttttacgctgtgctgtgtcggttttgtttttaattcgccagcagctttaatgtaaggcacgagcgtacagtggatgtacattacgttttcacggccgatgtcgctcttcatttggcggatcgcttcaaggaatggcagtgattcgatgtctccgacagtaccgccgatttctgtaatgacaacatctgcgtttgtctctttccctgcgcggtaaacacggtctttcaattcgtttgtgatgtgcggaatgacctgtacggttcctccaaggtaatctccgcggcgttcttttttaagaactgttgaatagattttacctgttgtcacgttgctgaatttattcaggttaatgtcgataaaacgctcatagtgaccaaggtccaagtctgtttcagcgccgtcatccgttacgaatacttcaccgtgctggtacgggctcattgttcccgggtcaacgttgatgtatggatcgaatttttgaatcgtcacgttcagtccgcggtttttcagcaaacgccctaatgaagctgctacaataccctttccaagtgaggatacaactcccccggttacaaaaatatatttcgtcatttcgtttgctcctctcttcgctcttagctacatttttaaaatgtactattttataaaaaatcatttagccttttaaatgatttataagaaaaatgaggggtgaaaataagaaagctccctttcaatttcttgaaagggagcataacgtactatgttctctcttcgtttttgaagagcccaaaatacatactacatagttcgactatgaaagtcaagatcgttttgaagatgaaatctgatactatttaatttcctcttcttcatcatcatagtcttcatcatcttcatcaacaatatcttcttcgatctcaagatcgtcgtcgtcgtcttcgtcaagatcttcatcgtcaaaatcgtcggcttcaagatcgagttcttcctcaacttcatccaaatcaaggtcatcttcgtcgatctcttcaaactcgtcaagatcaagatcttcttcgactgctttcttcgcttttttctttttcgccttgactgtcggctgagtttcttcatcaagctgatcatacggataccagctgcgaagcccccacgtctggtcagaaagcgccaggaagcggccgtcaatgtttaaatctgtataaaattgagcgatgcggtctccaagctcttcttttttcacgccgagcaaagatgcgatttcatttaaaagctcctgaaaaggaactggttttttatgttcttcaaataattcgtgagcgatttcaactaaagccatttcctttagctcttcctgtgaatattgtttgatacccaaggtcggacactccctttctattacttatatgtatctgttttatcaataatgaaagcgattttgtatcgttcttatacaaaccatacctctcattataaacaaaataaaacagaatatgctacccttaacagcgttaatttaaataattttacaagagtgatccgactgagagatgttttccgttaatccgcgagcattctggagatgaccagtctttgaatttcttgagtgccttcatagatttgcgtgatttttgcatcacgcatatagcgttctaccggataatcttttgtatagccgtagccgccgaaaatctgcacggcttcggtcgttaccttcatcgccgtatccccagccatcagcttggacatggcggaagcttttccatatggaagacccgatgattctaaccacgcagcctgataggtcaatagccttgaagcttctatcattgtcgccatatccgcgagtttaaaagcgatgccctgctgctcgccgatcgtttttccgaattgctttcgctcttttgcatattgaagcgccgcatcaagcgctccttgggcgatgcctacggcttgtgcagctatgccgtttctgcctccgtcaagcgtcttcatcgcgattttgaagccttctccttcttgtccgagacgctttgatacgggcactacacaatcttcgaacatgatttccgttgtcggtgaagaacggatgcccagcttcttttctttcttgcctgtaaaaaatccttcaaaatccttttctactataaaagcggtaatgccttttttctttttctcgggatcggtgacggcaaaaacaatgtaaatatcagcaacgccgccgtttgtgataaacactttggaaccatttaacacatagtcatcgccgattcgttcagcagttgttttcatgctgccggcgtcagagccagaccgtgcttcggtcaaagcgaatgcgccgattttctctccgagggccagctgtgttaagtactctgtcttctgttcctccgttccaaaggcaaacagcggccagctgcaaagagagatatgggcggaaagcgtcacaccggtggatgcgcacacttttgacagctcctccaccgcgatgacgtaggccaaatagtcacttccgattccgccgtaatcttcaggccatggaattcccgtcagccccagatttgccatttcccgaaacagctcgcgatcgaagcgttcttgttcgtcccgttctgccgctgtcggggccacctcatgcttcgcaaaatcgcgcaccaattttcgtatcatctggtgttcttctgataatgaaaaattcattgcttctcccccattttcagatcagcgcctaaaacggattgagccagaagctcgactatgtcatacgttttgacttggtcttcagcttccttcgcctttgtgccgtccccaagcattgtgagacagtacggacagccggaactgatcaccgatgggttgactgcgagcgcttgctctgtcctggcgacgttaatcctgttgcctgtttcttcctccatccacattaatcccccgccagctccgcagcacatgccggtttcccggtttctctccatttcaacaagctgcacgcccggaatggctttcaaaatctctctcggcggatcataaacttcattgtatcggcccaaatagcacgaatcatggaaggtaatcttctcatgaagcgggtgctgcggctttaattttccgttttttacaagctcggccagcacttctgtatgatgataaacctcgccttcaaatccgaaatccggatattcatttttaaataaattgtatgcatggggatcgatcgtaacgatttttttgacatcatttttttcaaattcagaaatattcttctcagccagctcttggaacaaaaattcatttccgagacggcgcggcgtgtctcctgaatttttttctttattgccgagaatcgcgaaggacacgcccgcgtgattgagcagcttggcaaaggaaattgcgattttctggcttctgttgtcgtaagaccccatggagcctacccagaaaaggtactcaaattcttttccttcttttttcatttcttttacagtcggaatctcagcatccggcgcctcgtcacgccaattttcacgttccttacggttgagtccccacggattcccctgccgctcaatacttgtcattgcgcgctgggcgtcactgtccatttttccttctgtcagtacgaggtagcggcggaggtcgatgattttatccacgtgctcattcatgaccgggcattgatcctcacagtttcggcaagtggtgcatgcccaaatttcttcctctgtgatgacgtcgccgatcaagcttggattgtaatcaagcgccgctgcggcttcctgcgatccgctgcccgctgacgccgcagccagctgattgcctctcgtatgccgaaacgctgctgcgggcacccatggggagcgcgaggtgacggcagcgcctttttccgtgagatggtctctgagacgcaaaatcaagtccatcggagacagcatttttccggtgcctgttgcagggcacatattggtacagcggccgcactcgacacacgcgtacagatcaagcagctgagactgcctgaaatcctcaatttttcccgctccgtagctttctttcgtttcgtcggtaaaatcaattttttcaagttttccggcagattccattctgttgaaaaagacgtttgccgggccggcgattaaatgggcatgcttcgactgaggcacgtacactaaaaagctaagcaagaataggagatggatccaccatgcgatatagaaaatcaccgccgcgcctgttttcccgacaccgctaagcataaacgcaatacctgaggcaattggctcgctccaagaaagcccatgctcatgccaaatcagattcatcccgttcccaagcagaacggtcagcattaaccctccgataaaaatgagaacgagtccggctttgaaaccgcgtttcagcctcactagcttttcgatataacgtctgtaaaatgcccacccaacagcaatcaaaatgagaaacgtaacaatttcctgaaaaaaggtgaaggcgggatagaccgggccaagcggcagattccggccgggagccagtcctttgatgataaagtcaattgctccgaactgaaccaatataaatccgtagaaaaacatgacgtgaatgattccgcttttcttgtccttgagcagttttttctgtccgaatacattcacccatatggcgtgaagccgttccttgaaccgttgatcaaattgttctttctggccgagcttgatgtaggccagtctcgttttgaccaaatacacaaacaaatagacagcgtaagcggttacaatcagaaataataatgcatttgcgatgagaaagccgctcattccaattccccctttttactgataaagaccgcgatcccctaccccgaatctgtataagattatctttatgataaataatgaatgagtgttcagtcaataattaaattcctgctgttcgggcacactacctttactacggaaaggagtgccggtatgaaggtatttatcgtgattatgatcattgtcgttattttctttgccttgattctgcttgatatcttcatgggccgtgccggatacagaaaaaaggcgtacgagcctgttttttcaaaaaagaagagtgacatcgaattgatccactgcggcgctgatctcgttgagcggatgatgaatgatattcgccaggccgcctcttctgttcacatgatgttttttattatgaaaaatgatgaggtcagccacaatatgtataccttgctgaaaacaaaagcccaagctggcgtatccgtttatttgcttctggattgggcgggctgccgggcaattaaaaaaacggcgctgcagacgatgaaaaatgccggcgtccatgtccatgtgatgaatcgtccccgttttccttttttcttttttcacatgcaaaaacggaatcaccggaagattacggtgatagatggaaaaatcggttatatcggcgggtttaacatcgccgaagaatatcttggaaagaaggcgaagttcggcaattgggaggattatcatctgcgcatgatgggagaaggcgtacatgatcttcaaacgctttttgcttctgatctaaaacgtaataccggaatcgttctgggttcggatgtttggccaaagcttcagcaagggactatttctcacaagatatatgcgactgacggttattcccttgaaaacatatacttagccaacattgcccaagcgaagaatcgccttacggtttgcacgccttattacattccatcaaaaccgcttcaagaggcccttattaacgcaagaaaaaacggcgtatccgtgagaatcattgtaccgatgaaatcagaccatccgctggtacgagaagcggcttttacgtattattcggagctcttggatgccggctgtcttatttatcgttattatcaagggttttatcatgtaaaagccctcatcatagacgaccatctcagcataatcggaacagccaacttcgataaacgaagcctgtttttaaatgaagaggtgaatgtcgaaattgatgacgaagcgtttacaagtgaagtctatgccacgattgaggaggatatgaaaaagtcggagcggctgaccatggaggatttcagcaagcgcacattcaggcagcgcccggcggaatggctcggcagggcattatcttatttcttataaaggagagttcctatgattttcagattcgggttcgtttcaaatgcgatgagcctttgggatgcgtctcccgctaaaacattgacattcgcgcgttattcaaagctttcaaagactgaaagaaaagaagcgcttctgactgtgacaaaagccaatttgcgcaatacgatgagaacccttcactatatcatcggacacggcattcctttgtaccgtttttccagttcgattgtgccgctggctacgcatcccgacgtgatgtgggattttgtaacaccgtttcaaaaagagtttcgggaaattggagagcttgttaaaacacatcaactgcgaacaagctttcatccaaatcaattcactctgtttacgagcacgaaggaatccgtcacaaaaaatgcggtaaccgatatggcctatcactaccgcatgcttgaggccatgggcattgctgatcgctccgttatcaacattcatattggcggcgcttacggaaataaagacaccgccactgcacaatttcatcaaaatataaaacagctgccgcaggagatcaaagagcggatgacacttgaaaatgatgataaaacatatacaacggaagaaacgcttcaggtctgtgagcaggaggatgttccgtttgtctttgactttcatcatttttacgccaatccagacgatcacgccgacctgaatgtagcactgccccgcatgatcaaaacgtgggagcggatcggccttcagccaaaggttcacttgtcttccccaaaatcggagcaagcgatacgcagccatgccgattatgttgaagccaactttttgctgccgctgttggaacgctttaggcaatggggaacgaatattgatttcatgattgaagcaaagcagaaagacaaggcgcttctccgcttgatggatgaattaagctccatccgcggtgtcaaacgcatcgggggcggtgcgctgcaatggaagtcataaatgtgcaaaaataggtttacgacttgtcagctttgggaacttaggctatataagacaacaatcgatggaggagaaagatcatgaaaaatatcaagtctctgaaagtagccgcacaggcctttactttaagaaatttgattcatctttataaaatgtgccattccggaagccacgaggtttatatttattcaaagaaaacgatgtgcaaaatcaaaagcttaattgagcttgaaacattccgcatggctcataatgaaaaggaatatttgatcgtagttgaaggaacaaaagcatcacagctcattgaaaaattccaaaatttcatcgagcctgctgagagagaagcgctctaacttacatacaaaaaaggatagacatttgtctatccttttttcttatgctcttacataatggagctgaaccgcttgtccaaattgttttgtccctattaaccgcagttttgtttcatatgttagttcgtgaaacagcgggatgccgcttcctaaaacgacgggaataacagtgatgatgaattcgtcgatggcatcttctttcataaaggcattcaccagctccgccccgccagctatccagatgtttgagcctttttcctgtttcaaacggtcagtgaaggctctggctccctcattgataaacgtcacatgttcatcttgataactgtcgggcgatcctgtaaaaacatagcaggttttatcctgatacgggaaaaccggtgttagcacttttacgtgctcatatgtgctccggcctaaaatgactgtatcaacagtctgataaaaatcactgtagccgttgtcgccttcaccttcaaattcatccagccaatcgatgcttccatcttcttttgcgatcatcccgtccaatgaaacagcaatgtacagcacagtttttctttccatgttctcctcctatcgctgcaccatttgcccgaattgcgcttgatgcagcctgctgtataggcctccggcttcgatcaggtcttgatgacggccttgttcttcaataccgttgtttgtaacaaccacaattctgtccgcgtctttgattgttgccagcctgtgggcgatgacaagcgtcgtgcgcccctcagacaactcttgaagcgccttttggatcgccgcttccgtctctgtatcaagggctgaggtggcttcgtcgagaatcaagatcgacggatttttcaagaacatccttgcaattgacagacgctgtttttgcccgccggaaagcttcacgccgcgttcgccaatcatagtatccaacccatcgggcatgttatggacgagctcttccagatgcgcctgcttcacagcttgccaaatgtcttcttctgatgcgcctagtcggccgtaggcgatattttctctaagcgtgcccgagaataagaaaacgtcctgctgcacgacgccaatctgcccgcgcaacgaagaaagcgtcatgtcttttatactgatgccgtcaatcgtaatgtcgccctccgatgcttcataaaaacgcggaagcagactgcaaagcgttgatttccccgcacctgacggaccgacgaacgccaccgtttcccccgcttgaatggataggttgatgtcattgaggacattgtgatggtcatcatagccaaacgaaacatgtttatagcggatattgcccttcaggccggaaacatctttcgaatcaggtgaatcctgaatgtccggctctgtctccatgagctccatatagcttttgaaacccgcgatccccctcggatacatttcgataatggcattaattttgtcaataggcctgaacagcacatttgtcaggagcacaaacgccacgaattccccgtacgataaggagccgcgaatgacaaaccacgtcccgcacaaaaggacaaacagcgtgacaaaccgggtcagcatatagctgattgaaccgtttttcgccatgattttgtaggaagaaagctttgtgacacgaaaacgctggttattgacggcgaaacgttctttttcaaacgcttcatttccgaacgcctgcacaagccggatgccgccgatgttattttctacacgcgcgctgaagtctccgatatccttgttcagcgtggtaaatgctttggtcatttttttgttgaaataaagcgctagccaaatgacgatcggcataatgataaacgttaataaagcaagctgccagttaataaacagcatcactccgaacgccccgagaatggtcatgaccgcaatgaataagtcttccggtccgtgatgggcgacttcaccgatatacattaaatcgttcgtgagcttcgacatcagcgttcccgtcttgttgttgtcgtaaaatttgaacgagagcttttgcaaatggtcaaaaagcgactttctcatatcagtctcaatattgataccaagcatgtgtccccagtaggtcacgatatactgaagagccgagctgagcgcgtacaccgcaaataacccgattgaggtcgcgatgatcagtccccaatccctgcccggcagcaaggtatcaataaaataattgacgatcaaaggaaaactcagctccattaaacctcccgcgatcgctgagaaaaagtcgagaaagaacaacgttttatatggtttataatatgaaaaaaattgccgcagcaccctatcttcccccaatgtataaataactgataatatttctcaattatactatacacgggctgttttgaaaaatcagatttcttttttcttacagaacacctgaaaacaggcgggcaaatgactcttttgtccggtcagccacgcctcttttataaaagccgacagggctgagcttttcactttcctgcatatcctcttcaaaatgggcctcaagggttcggatcgcttcggcatccgtgaagaacacattcacttcaaagttgagctgaaagctgcgcatgtccatattcgcggtaccgacggaggcgagatcgccatcaatgatcatgactttttgatgcatgaagcctttttggtaggagtacacttcaatgccctcaagaagcagctccgggaaataggacctcgacgcgtattgggtcaaaaagctgtcgttcttctccggcaccataacccttacctctaccccctttgtcgccgctgcttttagcgccgtgcgaatggattcattggggacaaaatagggtgtggcgatccatattgatttctgcgctgaagaaatcatttcataataaaggtcgctcatgctttctttcatgtcagggcctgtcgcgacaatttgataaatgcctcctccttccacgggaaccggggtattgtactcctcttgatcaattagcacttcattggagacatattcccaatccagcataaagatagcgtggagcgtttgcacaatttccccctcaagccgcaggtgtgtatctctccaaaatccgatgtacggatctctgctgatatattccttcccaacatttaatccgcccacaaaaccggttttcccatcgatgatcacgattttccggtgatttctgaaattcagcttctggttgaaaaacccgtatttcagcggagaaaacgggacgatgtccacccccgcttgtttcattctcataatatctcttcttgccagcttcatgcttcctgccgcatcgtatagaaacctcacctcgacaccctggcgcgctttctccatcataatgtccatcatgccgcgtccgagcatgtctgatttaaacatgtagtattcaatatgtatgtaagattccgcttttctcatcgctttgaaaatgtccgggaaggtttcttcgccgtttttcagcactttgatgttgcttttcgtattgatattcatatgggcagccttgatggaataggtaaagaatctctcttgattgtccttcagccctgtcacttcgggcgtttcctccttgtcaaacagcttcctgagcttttccctgttgtacattcgttttgtcttaaacagctttccctttacataaagctgtcccgaaaacagataaaacacgtagccgacgattggaaaaaagacaagaatatggatccatagcagcgtgtgctgcgaggtgcggttttcaagaattaatgaatagatgctgaacaaaataatgcttatatagcaaagcaatcctccgtaaaactcaagcctggaaaccggaaaaaaccaaatgacatatgccccgatgagcatcatatataaaaagaaaaattccagtctccttttcagcatcctgattctctccaatctgattcaattacctctgtattacctcttttttctaatcgataaaccttgtaagcaaaaaacctctccgccaaaggaggagaggtttagagaaaactaactgtcacggaattcatccgcatcgtttctgcagaaataaagcaagactattggcaacgccgagtgacaacataagcggcaggccgaacccgctcagcactccggcaagcgccgaaaaagaggcagcgctgtgactgcaaatacggtggatagagtgaatttgatacccattctgatgagagaaaatatataaaacgggatattgatcacaaagatataaggagttagtcaggctgagtcataatctgcagttcagccggtttaaaatgagtaaaatccgttttattcttgatgttatttccaggattcccggccgcccagccattaccttggcagaaaaaaccccctcttgcaagggggattttcacgagcgtttccgatatacaacgtagctgcgggtcagatacttgagcggcagactgaacacatgaaccaatctcgtaaacggccacaggataaaaacgacgtatcctattacaatatgaaacttaaaccatagcgggacactctccatcaaagaggcgtcaggcctgaacaaaacgatttccctgaaccagggcccgactgtggtccggtaatcaaatcctttcgaatcaatattgagaaacgtggccgcaacgcctgacagcatcatgaacagcagcaggagcagcgtaaggatatctgatggcgagctggttttgcggatccttttgtcaaacagccttctgtacgtcaggatgacaagtccggtacatgccgcaatgcccgccggcaagccagcgccaatcgccattttgtgatacatatgctctgaaatgccaagggaagcatacacgccttccgggatcagaatccccatgacatgcccgccgacaacgcacagcagtccccagtgaaaaagtgtgctgcccgcggcgagttttttcttttctaacatctcgcttgatttcgccgtccagccaaattggtcatgctggtagcggtaaatatggccgccgataaagattgtcaatacaatgtatggcataataccccagaggatctgcccgctcatgcctgaacagccccttcaacgctttcacgtacgccaatgttttcaagcgcggccagcagcacgtgcagcagttcagcgtatatactgtcatttttttcgagacgggatgccagctccctcacattggacagatatttctcaaacacgcttctcgctgcttcaatttctgcagccgcagcaaattccagcatcagcggcagataatcaggcagctctttctctgtcggcaggaaaccggattgctcgtatgtgttttttaaatgcagcaattcaacgccgcgttccctttgctcgcccgagttaaagtaggtgacatacatatttgtttttttcccaaagtcgaatgtatagacatagtgttcaatcagcgcttccggtgaaaagctggctgacgcttcgaaaaagtgcagcagcttctcccggatttgccggttgctgatttcatggataagagccttccaatcgggaatctcggctctccactcttcatccggataagagagaagagtggatagagcggagaacgtaatttgccggtctgtggtgttcatcttgttacacctcatttatcaaaagttagaaacaggagccggggccgcctgaaaatgataagccgcagctcccttgttcagcatataaatctgaaacttcttctcgatgactgctcggtatcacaaagcggtcatcatatttggcaatcgcaagcagccgatacatatcttcaatttgctgttctgttaagccgacactggagatcagttccgggtcgattgatttattcgtctggatcgctctcatatactggcgcatgacagacattttcttcaacgttgaccgaatatgatccgtatcaccggctgttaacagctgcgccaaataatctatcgggattctcatttggtcgatagccggaaaaatatcttccgcggattgccggctgccttttccttcaaagagattcataatcgggctgagcggcggaatgtaccacaccattggcagggtgcggtactctggatgaagcggcagcgcaatcttccagtcaatgatcattttatagatcggcgattgctgcgcagcctctatccattcagccggaatgccttgttcttttgccagcttggcaacctcaggatcatttggatcaagaaaaacgtccaattgggaatggtagagatccttttcattttcaacagatgccgcttcctccactttgtccgcgtcatacagcatgacgccgaggtagcggattctgccaacacacgtctcagagcagatggttggcagtcccgcctccaaacgcggaaagcagagtgtgcatttttccgctttgttcgtttgccagttaaaatagacttttttataaggacaggatgagacgcaatatctccatgaacggcatgcgttttgatccacaagcacaatgccgtcctcctcgcgtttgtacatggcgccggatggacaggatgagacgcacgccgggttgatgcagtgctcgcaaatacggggcaaatacatcataaaaacctcatcgaattctgttttgatcgattcctccatcttttgtacgttgggatcttcaagccccgttatgtggccgcccgcgagatcatcctcccagttcggtccccattcgatattcatgaaatcccccgtcaaggacgatttcgggcgtgctaccggctggtgttttttctgcgggctgttcgttaatgtttcataatcatagttccaaggttcatagtaatcatcaattgacggctgattcggattatagaaaaggcctgcaagccgattggttttcgagcccgatttcagctcgagctttccttttttcaatgtccagccgcctttatatttgtcctggtcctcccattgcttcgggtagccgatgcccggctttgtttctacattattgaagtacatatattccgcaccggaacggtttgtccacgtgtttttgcaggtgacgctgcacgtgtggcagccgatgcatttatccaagttcatgaccataccgatttgcgctttaatcttcaagccaatcgacctccttcagcttgcggatgacgacgttcaggtcgcgctgattccccgttggaccgtaataattaaagccgtagctgagctgggcgtagcccccgatcatctgtgtcggcttgacgtgaatccttgtcgggctgttatgggtgcctccgcggttattcgtcagctttgttccgggcacgttgatgtggcggtcctgggcatggtgcataaacgccattcctttaggaatccgatgagacaaaaccgctctcgcgacgacaacaccgtttcggttaaagcattcaatccaatcgttgtctttgatatccgtgtcctctgcatcatctttattcatccacacggtcggcccaccgcggaacagcgtcagcatcggcagagaatcaaaatacatgctgtggacagaccatttattatgcggcgtcaaataattgaggacgatttcttttccctcttgatcaggccgcttgctcagaaacgggcgatgctggaggatcggtttgaatgtcgccatcgtttcaccgaattccatcatcagttcatgatcgacataataggattgtctgcctgtcagcgtccgccacgggattaatttttcaacattcgtcgtaaacggcgaatacctgcgccctcctttttcagagccggaaaacgctggagacgtgatcaccgttttcggctgggctgtaatttgttcgaacgtaaagcattcttcctcgcgttcttccgccaggtctttcagcttcaggttcgtgatgttttcaagtgattcccatgctttgacggcgacctttccattcgaagtggatgatagggctaaaatcgcttctgctgcctgctttgcttcacttatatttggacatccctttgcgacgctgtccgaggtgatttctcccaatctctgtttgagtgattcatattcatcggctattgaccagctcatcccttttgttccgctcggctttagagcaacgttcggaccaagtgcagtcattttatgaaaaatgtgtttgtaatcccgttcaacgacttggatgttcggcatcgtttttcccggaatggcttcacattcgcctttgctccagtcattgattttgccgaatggctgggccaattcctgcatggtgtcatggaggagcggcgtcgcaaccacttctttcaccggctccatatcgacttcttctgccagatcggaaacggcttttgacagcgccttgaaaatatcccagtctgacttcgattcccacggagccgagatcgcaggagcaaaaggatgaatgaacggatgcatatctgtgctgctgagatcgtgtttttcataccatgtcgccgccggcagcacgatatcggaatacagcgccgtaccggccattcggaagtcaagattgattaacaagtcgagctttccttccggcgcctgctcccgccatttgatttcttcagggcggatgctgtcgctgtcgtcattcatcaagccgtttgtcgtcccaagcaaatgcttgagaaaatattcatgcccttttcctgagcttgagatcagatttgcccgccatacgaagagatttcttggaaaattcacttcattgtcgggatcttcaatcgcgaatttcagttttttctcttggagctgtgaggccacgtacgcaccaacgtcttcaggtgtttctgcccctgctttttcagcttctttatacagatcgatgccattttgattgaaagtcgggtaagacggaagccaccccagccgcgccgccagcacattgtaatcagcgtggtgcttgtagcgggatgacgcagcaatcggtgatgccaaatcactgatcggctggtcctcataacgccactgatctgtcgcaaagtagaaaaatgaggtgccgttttgcagcttgggcacgccttcccagtcctttgcagttgcaatcgtctgccacccttcagcaggtcggagcttttcctgccccacgtaatgggcccagcctccgccgtttacgccttgggcgcctacaagtaaaacaagatttaacaccgctcggtagatcgtgtcggagttgaaccagtggttaatgccagcccctacgataatcatggaccggccgtctgtatcgatcgcattttgagcaaactctctggcaatcttaacgacagcttcttttttgattcctgtcatttgttcctgccaagcaggcgtaaacggctcagggtcatcataggagacagccgatcgttcgccgatgccccggttcacgccgtagttagccagtatcaagtcaaacacggtcgtgatgtacgtttcttcaccgttcaggttcatttttttaataggaagatcccgctcgagcactttgtttccgtcatttgaaaaatacgggatgcgcaccgtgccgatttcgtcctctattcccagcacagagagacggggttcaatcggttccccggtttcttcatcaatcatgtgcaggttccatttctgctgcccgtcccagcgcgagcccattgtcccttggggtatggcaaatgaacttgtctgttcatcccaaactgcaggcttccactgatcatgctttgtcttccgcccgatgtccttcgcatgcagaaaccgtcccgctgtgtatacgccattttcttttgacagagtgacgagaaatggaaaatcagtgtattgcttcgcgtactcaataaaacgttcagtttcttggttcacgtaaaattcctgcagaataacgtgacccatcgccatcgcaagcgccccgtcagtcccttggcgaatactcagccagtcatccgcgaactttgaggattccgcaaaatctggactgatcgaaatgaccttagcgcctttatagcgggcctccgccaaaaaatgcgcgtcaggcgttctcgttaacggaacgttggagccccatgtgataatatagccggaattgtaccaatcactgctttccggaacgtccgtctggtcaccccaaatttgcggggatgctggaggaagatccgcataccagtcataaaaactgagcatagggcctccgattaacgacataaaccgggagcctgatgcgtggctgatcatggacatggccggaatcggagaaaaaccgacgtttcggtcaggcccgtatttcatcactgtatacagcagagaggctgaaatcagcttcagcacctccggccattcagcgcgcacaaaaccgcctttccctctcgcctgtttataagacttcgctttttcagggttttcgacgatcgatttccaggcttccaatggattttgatgcgtctgcaatgcctcccgccacaaattgatcagcacaccgcgcacgtatggatatttcacacggagcgggctgtagatataccatgaaaaactggccccccgcgggcagcctctcggttcaaaatcaggcatatccgggcctgttgatggataattcaaattttgcccttcccacgtgacaattccgtttttcacataaatattccagctgcaagaccctgtacagttgacgccgtgggtggagcgaacgactttgtcgtactgccatctgtttctgtatacattctcccaatcgcgatcctcgcgggtagtttggctatgtttatttgaatggtgttcgataggagagaaataattcaatctcctaaacaacggactcattttctttttcttcatgagagttcactccttccgagtcaggtgatgctaagttcactataaacagagacagcgcgtttccttgtgaactatgtcacacactctgcttttttcacaaaatgttcacacaaaggagaaggaaggattttcacaagatgtgaggaaggctgcgttcaggcaggacgcttgggtcattagccgcctttcattcaaagatccaaaaaaaccggctctatttaagaaccgggctcggcgttttcatcctgtgatgtatgcagataccgcaaaaataattgataggaacaaaaaacattttgctgaagcatagccaaaaagttcatttgcagctgcggatgataagacatcattttcttaaatatgtaatatgggatgttgagaatcagaatgtctgaagtggcattgactgagataaagggcgataaataaagcccgcctttttcatcaatcggaaacacatcgcctttttcccacagcgcaacggttttcgacccttcagggagccttgtgtccataaaacggacactgccttttaatacaatataaacagattgagaatgaagaaaagatggagactgatcacatgaaccgcggataaacgtgccgtttttcagcaaggtttcgacaatggatagaggcacttcattaaacataggaagttgtttcagaaataataaatagtcacactgattcataggaaaacctcctgtgctaaggatagctttagtgtagctcgactgagcctgtacagcagtgatgtatttcacagcctgtatgatgaatgtcacttatcaggagggtgaatgcatttataatgaaagaaaaaaggaggatttcgatgaaggcgctgattccgaagcagcacggggcgtgggcgatgctgctgatcccatttttactcggcatggtcaagggaggccccgttatttggcatattccgctcttcctaggctggcttttcctatacttagcggtttatcccgttacgcttgccttaaaaaagaaacaaagcaaaccatatcaaaagtggatgtgttattacggttttcccgcctgctgctttttgatgatctcggtctttcataagccgcctctcatctgggtgggcgtttctttactgccgctgtttctcatacatatgtattttgcccgcagaaaaaacgaacgagccctattgaatgatgttgcaggtgtcttgttcttttgttcgggcgggtttgcgagctgctggctggggatgggaacccttgacggctgggcttggtttattttcttgcagtctgctttattttttatcgggagttccttttatgtgaaatcggtgatccgcgagagaaaaaacagggcatttgcatactggtcatggggatatcacctgctgctcccctttttatccgctcttttcggagcaggatgggcgtttctcgcttttattccgagcagcttgcgggcatggttttttcatggaagggattggcccgtaaaaacgattggcattctggaaatcgtgaatgcctgcttctttcttgccgtcatgtgcctgtttatcacaaggtaaaaaaaacaaggacaccactgtccttgttttttcagtcaatattgcaaatctccagcgggcaattttcacactcaatctcacatcgtaaatagtcccgcttgtgcaaaataatttttccggattcgtctatcgaaataaccccttttttgcggagatctccgagcatacgattgacgctttcccgtgcagccgcgcaaaactttgccaaatcctgatttgtcaggacaatgttaatcagaatgccgtcgcttcgctccactccgtagctgtttgataagcggataagggtagaatagagcgccccctttttgccatgaagaagcagatccctgattttggactgaatcttccggaggtgcgtgctcatccatttcatgaactcaaatgtcaaagcgccgttttggattaattctttttccagcttatttttattaatgacgagcacctcgccatcctctagcacttttgcactgagcatatacctcggttcttcagtgaaaagtgttaattctccgacgatatcatgcttttggcagattctaagcgtcaggtcttttccgtcagatgtcagcttgccgatttcaatgagtcctgattgaatcagataaagctcttctgcatccattccttctcgaaacaaatacgtgtgtttttccatttttcttttcgtgctgatcgattccagcaattcatgcagatcgctggatataagatctctatcagatggtcgaacagagagaaaattcatgagctcacctcgaagaaagtcacgttgtgtgtttattgtaacgtgaattgatttgtacccatcgagaaaaaactaacaatcttgtgaatgccccagtgttagttgatgctctggctgtttctctccgtgtgtgttttcattctttcctgccaatacatccatatgacaaggacaaagctggctaacgccacctctgaaagcgccataaacccgatcgcgtactggcctgttgcctgaaacacactcgccaatatgagcggaggaaaaaagccgcctaatccgcccatggcagacacaatcccattggcaatccccgcttgcttcgaaaaatagaaaggcaccagtttaaaaacagtcccgtttcctatgcctgagcagacggccacggttaatgatccaaacgtataaaggccgattgtcggcgagaacgataggataatgcctgataatgtaagcccggcaaaaacaaacatcaagatgcggagcgggctcattttatcagccaggaatccgcccgcaggcctgagcagcgtagaaaccgcaataaagccagccgtccgcaagccggcatctgcaggattcagcccaaaatgctccaccagaaagttcggcagatagatagtgaaggcgacaaaggcaccgaacgtaataaaataaaacaggctcagaaaccatagcacatgatttcggtaaacggctttgatttgagtcttaacagaaactttgaccttcttctcatgcctgtcaccgaacaaaacgtgcagtaaggcaaagacagccagcaaaaccagatacatctgcacggttgatttccacccgacggcttgagcgataaccggcgctgcaaatgtcgtaacggctgtcccgatatttcctgcaccgtaaatcccattgacgacaccgtgcttttctttcggataatatttcgggagggaggtcactccaatggaaaacaccgctcccccgatccctaagaaaaagccgccggcgattaaatcaaacagagaatccgcgatactgatccaaaatacaggaaataaaagcaggatgaaactgatcataaacatcagccgcgcgccaaacctgttcgttaaataccctagaggaatgcgaagaagcgacccgaggataacgggaatcgccgtcaccaaagaaatctcgcccttgcttaaatgaatatctaatgtgatttgggaaatgagtgatgaaatcagcacccaaaccataaaccctgccaccaagcttaatgactgtaacgataattgaatgtgttgacggttgatcatttggcttgcccctttcaatgattcaataatcagtcttatcatacaaaaactcggcaaacaggattgtgaattacatcacacgtttttctcataaaaaaaggacaaagcccgaagactttgtccttttgatcgtgattacattttttccggagccgatacgccgatcagctgaagcgcattgttcagcgtaatttgcgttgccttcattaaagccaggcgcgcgcggcttttctcttcattttcagggtcgatgactttctctgcattgtagaagctgtgcagagcagaagccagatcataaatatagttagtgacacggtgcggaattcgtttttccgctgcttccgccactgcctctgggaagccgccgatcgttttcagcagatcgtattctttttctgattgaatatggctgaaatcaagatctgccgccggtttaagtccctgctcttccccttggcgaagcatgctgcaaatacgggcatgcgcgtattgtgcataatacacggggttttcgttagatgttgatacagcaagatctaagtcaaaatccatatgggtgtccgcacttcgcatcgcaaagaagtaacgaacggcatccaagccgacttcttcaatcaggtcacgcatcgttacggctttaccggtccgtttgctcattttcattttctcgccgtttttgtaaaggtgaacgagctgaatgatttctacttcaagcgttcctttttcatagcccagcgcttcaattgccgctttcatacgcgggatgtagccgtggtgatcggcgccccaaacgttgatcagcttatcaaagccgcggtcaagcttgtccttatgatacgcgatatcaggaagcaggtacgtgtacgtgccgtccttcttgatcaatacgcggtctttatcatcgccgaacgtcgtggaacggaaccaagtcgcgccgtcttcttcatagacatggcctttttcgcggagcgcttcaagcgccttgtcaatttttccattttggtacagtgaagtttctgaataccacacatcaaacggcacacggaagttttccaagtccttgcgaagcttttccagctcgtatttcaggccgtattcacggaaaaacgcgaggcgttcactttcctcttcgttaacgaaacgatcaccgtattcctcagcgagacgctttccgatcgcaatgatatcctcaccgcggtagccatcctccggcatcggtttttccaatccgagtgcttcaaagtaacggacttcaacagaaagcgccagattgttgatttggtttcccgcatcgttaatgtagtattcgcggcttacatcgtaacccgcttttgaaagcacgttgcacaaggaatcgccgacagccgccccgcgcgcatgcccgaggtgaaggtctcccgtcggattcgctgatacgaattctacctgaactcgttcaccgtttccgatgttcgtttccccgtatgcttcccctgcttccagtacagacggaatcagctttgttaaatactgattgttcatatagaaattgataaaacccgggccggcgatatccagtttttcaatcgaagccttccctttatcaaaatgggcgacaatctcttcagcgatttgacgcggcgctttttttgccactcttgccagctgcatcgccatattcgttgagtagtcgccgtgtgttttatctttcggtgtttctaaaacaacattgggaatctggctttcttcagccagtcccgctttcagaacggccgctttaatttcttctttcagcacgtccttcatttgttccgcaatgttcatgcgtgagttcctccctcatacgtgatcgtcatattatgtaaatgctcctgctcgtctccgacatgcatgtcatatgcgatgctgatacggcctttttcttcatcgagatcagattgaatcgattttgtgcttgttttcagctcaagctcaccaaatgacattttatatttagcaattgtggaagctcccgttacgaaacgctgattcattttgacagcgcctgacctcatgaccaggacttcgccttcgcttactttcacaatcgttttgactttgcctaagtcgtgttcttcataataagatagatacactttattttgttttacatagtaaaatccggtggtgcggaattcgatgacttcttggtttccgtcatcctcgatcacagacttcacatggagtgttatcggtgtctcttgcttcattctgacacgtccttttcatcattccactttgacttgaatagtataatcattcggtttgtaaacttcaactgcttctatcttaccatcattgctcatcagatttgaagataaacctcataaaaagcatttccttatatagaagagaaaatcatatcactaattacctttaggaaatgttacatttttccgaaatctatcattttcttttcacatttttttcaaattatatgtattgaattagtaatttgatagttttaagataaaagtacaacatagatctgctagaaaaacaaaaaaagggaggattcaattatgaaaaaagctgtcattgtagaaaacaaaggttgtgcaacatgctcgatcggagccgcttgtctagtggacggtcctatccctgattttgaaattgccggtgcaacaggtctattcggtctatgggggtaaggatctcccaaaagggcatagtcattctactatgccctttttaagtaaattacaatttttaactaaaatctacctcttggatatacatacacaaccgtttttcatttgaatcatatgtataggggatggtattttgtttatagagcagatgtttccatttattaatgaaagtgtaagagttcaccagcttcctgagggcggcgtgttagaaatcgactacttgcgcgataatgtctccatttctgactttgagtatttggatctcaacaaaacggcttacgagctctgcatgcgcatggatggccaaaaaacagctgagcagattttagctgagcaatgtgcagtgtatgatgaatcaccggaagaccataaagattggtattacgacatgctcaacatgctccagaacaagcaggtgatccagcttggaaaccgggccagccgccatacaatcaccacgagcggaagcaatgaatttccgatgcccctgcacgccacctttgaactgacgcaccgctgtaatttgaaatgcgcccactgttatttggaaagctcacctgaagcgctcggcaccgtgtcgattgagcaattcaaaaaaacggctgatatgctgtttgataacggtgtattgacatgcgaaatcacaggtggagaaatttttgtccatccaaacgccaatgagattcttgactatgtgtgtaaaaagttcaaaaaagtcgctgtcttaacaaacggaacactcatgcgaaaagagagcctggagcttttgaagacttacaagcaaaaaatcatcgtcggcatttctcttgatagtgtcaattccgaggtccatgactcctttagagggagaaaaggctcttttgcccaaacttgtaaaacgataaaattgttgagtgaccacggtatatttgtcagagtcgctatgtctgtcttcgaaaaaaacatgtgggaaatccacgatatggcccaaaaggttcgggatctcggggcgaaggcgttctcttacaattgggttgatgatttcggaagaggcagggatattgtccatccaacgaaagacgccgagcagcaccacaagtttatggaatacgagcaaaatgtgattgatgagtttaaagatctgattccgattattccctatgagagaaaacgcgcggcaaattgcggcgctggctggaagtccattgtgatcagcccgttcggcgaagtacgtccttgcgccctctttccaaaggaattttcattgggaaatatttttcatgattcctatgaaagcatctttaactcccctctcgtccataaactgtggcaagcgcaggcgccgcggttcagcgaacattgcatgaaagacaaatgcccgttcagcggctattgcggaggctgttacttaaaagggctgaactctaacaaatatcaccggaaaaacatttgctcttgggcgaaaaatgaacaattagaagacgtggtccagcttatttaggagggaaacgatttgtcaccagcacaaagaagaattttactgtatatcctttcatttatatttgtcatcggcgcagtcgtctattttgtcaaaagcgactatctgtttacgctgattttcattgccattgccattctgttcgggatgcgcgcgcggaaggctgactcgcgatgagcattttggatatacacgatgtatccgtttggtatgaacgggacaacgtcatcttagaacaagtggatttacatttagaaaaaggcgccgtttacgggttgcttggggtaaacggcgccggaaaaacgacactgattaatacgctgacaggcgtgaaccgcaatttcagcgggcgctttacactgtgcggaattgaagcggaggccggcatgccgcagaaaacatcagatcagctgaagactcaccgttacttcgccgccgattatccgctgctatttacagaaattacggcgaaggactatgtgtctttcgtccattcgctttatcaaaaggatttttcagagcagcagtttgccagtttggccgaggcctttcatttttcgaaatacatcaataggagaatttcggagctgtccttggggaacaggcaaaaggttgtattgatgacaggcttattgctgcgcgctcccctgtttattttggatgagccgctcgtcggtttggatgtggaatcgatagaggttttttatcagaaaatgcgcgagtactgtgaagcaggcgggaccattttgttttcttctcatctgctcgatgtcgtgcaaagattttgtgattatgcggctattcttcacaacaaacagattcaaaaggtcattccgattggagaggagaccgatctgcggcgggaattttttgaggtgatcggccatgaataacataatccctatcatgtctttgctgttcaaacagctttacagccggcaagggaaaaaggatgccatccgcattgccgcaggccttgtcattctggccgtgtttgaaattgggctgatccgccaggccggcattgatgaatcggtgttgcgcaaaacgtatatcatactcgcgcttctcttaatgaacgcatatatggtgtttctttctgtgacatctcaatggaaggaatcttatatgaaactgagctgcctgctgccgatttcttcacggagcttttggctcgcccagagtgtcgttttgtttgtcgatacctgtttgagaagaactttattcttttttattttaccgctgttcttatttggaaacggaacgctgtcaggggcgcaaacattgttttggctcggcaggttttcgttttttaccgtttactccattattttcggagttgtgctaagcaaccacttcgtcaaaaagaagaacttgatgtttctgctgcatgcggcgatattcgcctgtgtatgtctcagcgccgctttgatgccggccaccacgcttccgctttgcgcggttcatatgctgtgggcggtgatcattgactttcctgtctttctgcaggcgcctccgcagcagggcaagatgcattcatttatgcggcgatctgaattttcgttttacaaaagagaatggaaccgatttatctcttctaaagcgatgctgttaaattacgcggtaatggcggtattcagcggcttcttttcgttccagatgatgaacaccggcatcttcaatcagcaagtgatttatatcgtgatttccgcgcttttgctcatctgctcgccgatcgcccttttgtactcgattgaaaaaaatgaccggatgttgctcatcacgcttccgatcaagcggaaaacgatgttttgggcgaaatatcgcttttattcaggcctattggcaggcggatttctccttgtcgtgatgattgtgggtttcatcagcggccgtccgatttcagttctcacttttttgcagtgcattgagttgctgctggcgggagcttttatcaggttaactgcggatgaaaaaaggccctccttcagctggcagacggagcagcagctatggagcggtttctcaaaatatcggtcttatctgttttgtcttcccctattcttagccacattagccggcaccgctgtatccttggcggtcattccgatagccggtctggtcatagtctattacctgcaaaaacaggatggtggtttctttgatacaagcaaaagagaacggcttggaagttaacctgctgaagactcatcaattttcaactatatcaatcgccgcgagctttctgaaaccgatcgaaagcgcggcggaacctgaggaagaaacaatttatttttacggcgccgccgcgtacctgaaggagcaaatcattgacgctttcggttgtgctgccggcagccgtttcatgtactcagcgaatctcttttttgatcagcagctgaaaacctgcgggacccgtttgattcacccattatataacgggaatcttcatgttgacgccctgctgaaaacttttgcagacttgtctttcccttcttctctttcattcgaagcagttgaaaaggccaggaatgagctgctgctgagaatcgaaaagaaattcactgatcctttctcctactcggcggcgcgcttggctgaggaggtcttcggaaacccgatgtacggcacaggcatgtttggccggagagacaggataaaggcgattcatcctaaacggtttctcgacgcaacggactttatcgttgatttagtgtcccagcaaaaacagctgaacatattgggacaagtacaagcatgtgatgttcggggacatgccccgcaaacgtccgctgtaacgtccggaagaatacccgtaaaccggcatatttttgaaacagagacacgcagcgctgcaggtccttccgtcttgacactcggatttgactgcggagagatgaaagatgccagcgattatatcaaaatacagctaatagacggattactgggaaagtacggccattccgctttattcaagcacttcagagagaaggatctggcagtctatcacgttatcacccgttacgatgtcatgaacaatttgctgcttgtttcaatatgtacagatcagcttcatgagaaagacattcccccgcgcgttttggaagctgtctcagcttttcatacagatgagcgggaactagaacaggcaaagcagtttttacgcaatgaattgctgctgcaattcgattctcccgaaggtctattggcctatatgggggtcctgcgccgcttctcctgcacgaaagaagccttgctggatggcatctcagcggttacatgccgtgatgtattgcaattcatagcgaccatcaattatatcggagctcatgtagtaaggggatgaagagatggaaaagaaagccttttttcaacagctggatgaacgaaccgatatcagatacacagacagcggactaaaaatattcagattgaaattcccccgcgcccacctgcggctgtgcaatgtaaaaatcgattttggaagccgggatgtatgtatacgggcagaatccggtgatacactgcttccgtatggcacagcacattttttagagcatcttctcttctggcataacggccgcaatctgtacagtgatttttttgcgcatggcgcgcttttaaacgcattcactacctacaccgataccaatttcatgtttacctcattaccggatcggctcagacaaacgattcccatcctgcttgatgctttatggaaccactcatttgacaagaagattgtcgctcaggaaaaagctgtgattacaagcgaaattcaaacagcacaccttaaccatcagctctcatatcattatcagctgatcagcatgctttctccctcctcaccagctgccgttttccccgcaggcagaatcgaagatattgaggcgctggacatcagtgatttacaaaaagcctataaggctgcctaccaagcccatcggatgacgctgtttttgattgggggctcagaaaatacagaaacgcttttgcctcctcacctccagctggaaaagcgtccggattatcatgctgaaagaaaaatcatcccggcatgccctccagccctctcacaaaaaatgatgctgggtgatgaggagcggatggaagatacctggaccggattacagatcggcgcacttcccgggcaaaacgatctgttgtcgataaagctttattgggatatcgcggctcgtattctatttcaattagattcaccgttttttcaagagattcagcaaacgtaccgcctggaaatcgatcgcttgtcagccgagacttatatatatgaggatggcggtttcttgatccttcacagtcaagggacccattcttcagcttatatcgatgtggcttcatactatgtcacacagaagaaagaacaggttgccgcctggcttcaatacggcaaggactctttgacagacgcgatcatttatgacagcgattatgtgcgtaaatgcttcgagtgggcagccgagtgtgacaggtgcgattgctcgtttcttgacatgtaccacatcattcaagatatggatgcgcaggttttcttgtctctcattgatgcaatggcatcttctaacaaagcgatcattcacgtttctcagaaagaggcgatcagacaatgaaacaaagcactgtctttacccttttattgctgcttataggtatggcggcttattccttcggctgggttcaggccgttgccgaagccgccgcccaatatgtacagatgatcaacaatgatgctgtgcggctcggactgctggcttgtaccgctgccctcctgatgctgcctgcttttctctatcttcactatgtcacccaatccgtgaaaaacatgacagcagcttttcagaaactcacacagtctcatcaaagctgctgtgactttcagcaacacaacttgtgcagccgatatgcagaagacgtcaaatcgctgcgtgacagctataaaaacgtccgccaaacatacgtgatggctgccgtgttgtgccaagtcatcatattcggctgcatgttcgaaatcgttaaagccgtccctttccgccttcatacgccccctgccttttcaatgggacttgcgatgctactgatcctgtatttattgttttgcatgcgaacgtatttgcggcagcttttccggcacggcagcctgttcagaaaagtgtttgcgggagcactggcagcagccgggatttggtggatgctcagtttctctataagtgaactgctgtttctgattatcctggctgccattcagcaaatcggatcatttatttataaacgattctcttatcacagcaccgcttctcttgatctataaaatagctacatcgcaatcgcagacggacccgcgccaaccggaatcaccgtcacggctgtataatcacttgtgcggtacacggtcacagcattgtcgttgggctgtgccgcataaatatactgtttgtccggcgttacggcgaggtcaaaggcgccggggagagacacgtttgcaatgatcctctgtctggccgtattaactacgtataagttattaatgagaaacggttcactatatggctctagaaaataagctctagtactatcgagagaaaatacaatcgtcctcagcgtttcaaataaacggctgaagtcccctcccctgcttaatggtgacaaactaatctccgttacacctttcggccacagctcaccattcaatacgtacgcaaaatttccagcgtaaggagttgtaattaaactgggaaattcaaatgtatctatgatactttctaccaactgcccagtatttacatcatatttatcaaccgaccaactgcttccattagcggtatagacatactgtccattcggatcaagagcaaagtctaaagcgccgggtatcggaatgacatcaatgaccgattgagaggccgtgttaatcacatatatagatccggcggccatcacgtatgcgaactcatctgttggatcaaattcgatttttctcggccctcctccaacagtaatggtatttatgatagttaatgttttattatcaatcactgagacaaggttggtatttccatggaggatatacgtgaatgctttatcgaaagtaacgcctagattagttggcacagcagaaaacgggattgtttttacaatagtgtttaaatctgcatcaatgactgaaaccgtgctgtctccagtattggcagtaaacacatacgattgagggtctggcgatggcggtaaaacaagtatcccggccaccgtgagcggactgccgtagaaaggcggcacaatgagaagatcttccactgtcatttgactaaaatcaggacagcggccagactgtgctgcataataaacaacttgatcaatctcttcagtatgaatcacagaaacagccccgtctccttgtccatattgatttcgtacaggcgacacactgacaagaagcgtaatggccccttgtactctcacggcatatcgaacaccgatatcttctggttccggcccagtctggattaagcaaggctcactgatacaggacaaattgtctgtactccatgtaacagccgctgacgcttcggccgaatcaaccttgaagccctcagggatatctatcggcacttgaaacggcgcttcccggctaatttcctcatcacaaaaacagaaacaattttcctgtaaaacagaaagatcattctttttcatgatttcacgtccttttagaaatgcaccacacatagttgattaaatcgcaatagctcccggtgaaaccccaagagatatgacagtctccacggagtaatcatccgtgttgtaaacaatgatgctctgctctataaaacgagttgcatacagaaaatcgccattcggggtaaacgcatagtctgttgctgattgcggaagatttccaattacacctgctccattcggactgacagaatataaattgccagtgaagctgtcatgtaaatacacctctgatccactcgtaaacattacatatagcccgtcaggctccagctcttgggtatccctgatcgtaaacgtatttaaatcaataaccgtcaaataattgaataagaattcttgttctaatacatacgcataccgctccgtagaatctgtttctatggatgatacgataagctctcgttcaatcgttcctaagacttcaccggtagataagtccactttttgcactaacccaaaattaagaacataggcgaacaacccattggggtcaattgcaatatcaaaaccttctacaggaatagacctctcaacagtcaacgtatcaattccaatcacataaatggcagtaccggtgaaaacataagcaaactcatgattagggataaatctaatcaatcgaggcggctgatccagcaatatagttgctgtcactgttaatgtgtcataatcgatgacagaaatcacattattgttgggatgtaagacaaacacagcgcttttatctggcgtaatttcaatacctgccggattgtacggaagagcaatcgttgtcacaacagtatgggtgtttgtatcaatcacagaaactgattgatcatttggattcgctgtaaacgcgtagacgggttccggctccggtacaagcacaatcgtccccgtcaccgataaaggactgccgtaaaacggcggaacaacaacaaggttctcaatcgtgatgtcactgatatccgggcaatcatccggttcatcggaataatagacgacttgatcgatttctgcattgtgaatgacggaaacagccccgtccccttgtccatattgatttcgcacaggtgagacactgacgagtagcgtaacggttccctgcaggcgcactgcaaattgaacaccgacctcatcaggctctggccccgtttgaattaagcaacggtcactgacacaagaaaggctgtctgcattccacgtcacgtttgcaacagcttcagccggatcaacgacaaatccttcaggtaattcaatcggcgcttgaaacatggcttctcggcttgcttctccctcacaaaaacataagcactcttcttgttctgctcctgctttttctttaaaggaaagcttattttttctcattccttcacttccttttcagacatacactgctcacgcagatataacagaatatggaagggtaacgtgtttgcttgtacaaattgctgagggtaaaagcttctttttgaaaatatatctccaaacatgcggtgtaacgaaagaaaaaattgcggtttttttgcgcttctcacaagaatgttgatgataaaatatgacatatatagaattatgaagggagggatttgcaaacgtgacaggtgtcatatcttcttcttccatcggagaaaagattaacgaatggtatatgtacatacgccgattcagcatacccgatgcagaatatttgcgacgagaaatcaagcaagagctggatcaaatggaagaagatcaagaccttcatttgtactattcactgatggagtttcggcacaacctgatgcttgagtaccttgaaccgttagaaaaaatgaggattgaggaacagccgagactgtctgatctgctgcttgagattgataaaaaacaggctcgtttaactggtctgcttgagtactattttaatttcttcagaggcatgtatgagctggaccagcgggaatatctgtcggctattaaatttttcaaaaaagccgaaagcaagctgatattcgttaaggatcggatagagaaagctgagtttttctttaagatgtctgaatcttattactatatgaaacaaacgtatttttcaatggactatgcacggcaagcatatgaaatatacaaagaacatgaagcttataatataagattgctgcagtgtcattctttatttgccaccaattttttagatttaaaacagtatgaggatgccatctcacattttcaaaaagcttattctatggcagaagctgaaaagcagccccaattaatggggagaactttgtacaatatcgggctttgtaaaaacagccaaagccaatatgaggatgccataacttatttcaaaagagcaatagctgtttttgaagaatcaaatattcttccttccttacctcaagcgtattttttaattacacagatccattataaattaggaaaaatggataaagctcatgaatatcatagtaagggaatggcttattcacaaaaggccggagatgtaatatatttatcagagtttgaatttttgaaatctttatacttatcaggcccggatgaagaagcaattcaaggattttttgattttctcgaaagtaaaatgttgtatgctgatcttgaagatttcgctattgatgtggcaaaatattatcatgaacgtaaaaattttcaaaaagcttctgcttattttttgaaggtggaacaagtaaggcaacttattcaaggaggagtgagtttgtatgaaattgaagtctaaactattactctcttgtctggctctatgcactgtgttcgtggcaacaactattgcaaatgcacctacacaccaaattgaagttgcacaacgaggaatgatttaaccgccgtccatcggcggtttttttgtcccctctttacccagtctcccaatccatgctatgattttttcaataatcttaaaaatagtggaaatgcagcatgtctctggaaagtgtgagaacccactttaaacagtggaatcgagaaaatgatgtgacggagttcgaaacgtcgagcgcgacagttgaacaggcagctgagacgaccggcgtgagcccggctagaatcgccaagaccctgtccttcagaggggaaggagatcaggtgattctgattgtgacagccggcgatgccaagatcgacaacaaaacgttcaggcaacatttggctttaaagcaagaatgctctctcctaatgaggtactggagcagacaggccatgaaattggaggagtttgcccatttggatcggctcatgatcctgaggtttatcttgatgtatcgctgaaacggtttgagactgttttccccgcatgcggcagcagaaacttcgctattgaggagaattatccgaattttctttcttaaaagcatggattgatgtttgtaaagactgggaataaaaaaacatccagacatcgtctggatgtttacttatttcacaaaaccaagcagcatttcacggatgattttactggctgtgtttgccgtttgctctgagtggtcatacaccggtgcgacttccactaaatcagcgccctttacgtttacctctgaacgcgcgatttcatggacggatgcaagcagttctttagacgtgatgccgccggcgtcaaccgttcctgtacccggtgcgtgtgcagggtctaatacgtcaatgtcaattgtgacataaaccggacggcccgccagcttcggaagcacctctttcagcggttcaagcacttcaaattttgagatgtgcatgccgttttccttcgcccattcaaactcttctttcatgccggaacggattccgaatgaatacacattgtgcggtccgatcaattctgccgccttacggatcggcgtggagtgagaaagcggttctccctcataatcaacacgaagatctgtatgtgcgtcaaaatggatgatcgcaaggtctgggtatttcttgtacatcgctttaatgacaggccatgacacgaggtgctccccgcccatacccattgggaacttccctttttctaaaatgctgtccacgtactcttcaatcatatccaggcttcgctgcggatttccgaacggcagcggaatgtcgccggcgtcaaagaagttcaagtcagccagatcgcggtctaaatatgggctgtattcctcaaggccgattgacacctcacggattctgcttggaccaaagcgtgagcccgggcgatagctgactgtccagtccatcggcatgccgtaaagaatggcgtccgcttcttcccactcgggacggctcgcgataaatacttttcctgaataagcttcatcaaatctcatctataataccctcgctttcctgtaaaaaagcgcaagattcgctcctgcgccataccttcattatttaatcaggtcactcacaaatttcggcagaacaaacgccgctttatgaatatcttttgtgtaatatttcgtctcaatatcgaagaaacggctgtcttccactgcaagcggatcatattttttcgagccaattgtaaatgtccacaaaccgcttggatatgtcggaatgttcgccgtatacagcttcgtaatcgggaagatttccttcacgtcgcgctgtacatttgtgattaattccggtgtaaaccatgggttgtccgtctgcgcaacgaaaataccgtcttctttcagcgcttttgcgattcctgcgtagaatccttttgtaaacaggtttacagccggtccgactggttcagttgaatctaccatgatgacgtcgtattgattttcagattttgcaatgtgcataaatccgtcatctacctgcacgtcaacgcgcggatcatccagtttgcctgcgatagaaggaaggaactttttagagtattcgataaccttgccgtcaatgtctacaagtgtcgcttttttcacgcttgggtgcttcaggatttctctgataacgccgccgtcaccgccgccgactacgagaacgtgctccggatttgggtgcgtaaataatggcacatgcgccaccatttcgtgataaacgaattcgtctttttcagatgtcatcaccatgccgtccaaaaacagcatgttgccgaactcttctgtttccaccatttctaaatgctgaaactccgtttgttctgtatgtaacgtcttgttaaccttcatcgtaatgccaaagtttttcgtctgcttctctgtgtaccaaagttcgctcaattgtcatctccctttcgaggctgtattcatttattgtaagcgtcttatcagcttttattctcggttgaaatctcattttcacctaaggaaaaagtatagaggatggcggggaaaaagtaaagatgcgtcctgttctgcgatgtttaaaaacgatctttttttctcataatagtagaaacataaaaaaagggggaacccgttgtggatgcaatgacaaataaacggctgagactgacgctgaaaaccgttcgcgcctttatctttttaggggcttttgcggccttggcggcagctgccgtgtttatgactgtcattttgatagccaaataccagggcgctccctcggtgcaagtgccgcaatccacgattttgtatgcgagtgacggctcaaagctcggggaaacgaactacggcgaaaagcgctattgggtccccttaaaggacatgaatccgacgatcgtaaaagcgacagtggcgattgaagaccagaatttctacgatcatcacggctttgattataaacgcatggccggcgcggcgcttgctgacctgaaagcatttgccaaggttcagggtgcaagcaccatcacccagcaatatgccagaaatttataccttgaacacgacaaaacgtggaaacggaaatggaatgaggcgttctacacgatccgtctggaacaaaactattctaaggacgagatattagaaggctatttaaatacgatttactacggccacggcgcctacggcattgaagcagcttcccgcctttatttcggcaagcatgccaaaaacctgacggatgcggaggcggcgcttttggcaggaatcccgaaaggcccttccggctattcaccgtatgtcaatgagacgaaggccaaggaacgccagaaaacgatcgtgcggatgatggaaaagcagcagatgatcagccaaaagaaagcggatgaattgatcaaggaacctctttcctatcagcctttgaataaacaagtttccaagagaaaggctccttatttctatgacaatgcgatgagagagctggaaaaaaagctcggcatgacacgggagcaaattgaaacgagcgggttaaacgtctatacaacggtagataaacggatgcagcgcatcgccgaggagaccataaccgaaacggttaacgcgggctctgacattcaagtcgggttttcagccattgatccccgcaccggaaacgttctcgcccttgtcggcggcagggattatcaaaaaagcccgtttgaccggacgacacaggcgaagcgccagcctgcttcgacgatcaagccgttgctgtactataaagcgattcagagcggatttacgccagtcactttgatgaaaagcgaagaaaccgagtttcaaattgatgcaaagggagaaacctattctccaagcaactataacggatactatgccaacaagccgattacgcttctgcaggcgctggcgctttccgacaatatttacgctgtgaaaacacatctttttctcggcacgaacaaacttgtaaagacggcaaaggaattcggcattaccgcccatcttcaagcattgccgtccctggcactcggcaccgaacccgtgcgtccgattgagatggtcaacgcctatgccatgctcgcaaatggcggaaagaaaatcgaaccgacttttatttcaagggtaacggacgcagccggccacgtgctgtacgaaaacccgaatcagcataaacaggtgcttgatgaaaaagccgcttttgtcacagcgagtatgatgacaggcatgtttgataccgatttaaatggatatacgtcggttacgggacgaacgatagccaaccgcctgacaagaacgtatgccggaaaatcaggaaccacaagcgcagacagctggatgatcggcttcaatccgaaactggccgcaggtgtttggaccggctatgacaaaaacagcaccatcgactcagtcgaagaaaaaagctatgctaaaaccatttgggcggacttcatggaggacgcgctcaaaggcgaaccggaaaccgcgttcaagccgccaaaaggcgtaaccggtgtgtacattgatccggaaacaggctactcatcaggtcccggctgcgccgctaagcattacacatattttgtgaaaggcacagaaccagcaaacgtgtgctacggggcagaacccgcaaaacaaacaaaagaccggcttccatccaaagaaaagcccgcttccgagaaaaaatggtgggacaaatggctggggcgacatcattgaaaataacccggctcctcggaggccgggttattcgtatggttccttcataatcgatggaagaatgttagacaatcgagctgaacaatcagttttgggataaagtggtgaatttttcatttcttcgacgtcggctttcatctcccagtcgccgactcatatccccctaaaaatgaaaaaccccgagtcttgtttcggctcgggattttccatgtcctatttctgtatcaccagtttactcaatgtttacgaaaaatatctcaaatactttaaaagttcacagaaaattcacaaattaattatcttccggaagcaggcttgtttttaattcatctgaggaacggtcccataggccctgatcatgctttttcagaaattcgcctagtacacgcttcgagctgtcgtccattttatcaacgatgattttccgtttcatggatttatccatcaaattcacatgctcaggcagcgacttgtagcctcttctgatgcttctgtcgaccgtcatttcacaggctgtcacaccagcgtaataaggcccctcttcttttctgtcaatcgttacccacacaagccagtatggttttccgttcggaacttcttctttattcgggagaaatttaattcctttttcgacggtgctgcgggcatgcatggcgccgatgtctacgaacgcttctttttcctctacatcaacgaatacgggagaaatgttatcaaggctgagtgcccctacgccaaaaccgccgtgtccgtctgtcggatcacttttgataatattaaacccgattgattttttctttttttcttccatgaagtcctacctcctacaaaagcggttgaaatatcgctgaaaacagctttaaaatcgaatctcttcctgcattgagcatcggccacagcacgtaagatccgagcggtgtcacaaacagcaccaaaaacacgataaagccgtagctctccgcctgcgtcattttggcacgcacgcccggcggaacgagatcttctataattcgatagccatcgagcggaggaagcggcagcagattaaataaaaacaagacaagattcagctgtatccaaatagaaaaaaactgatcaagccccgtgctgaacgccgcaagcatttccattccgtacgcatgcatcaacactaacaaaaagaaaccaataaacgcaagaatcaggttactgacgggcccggctatagatacgagcacaccagcaagccggggtttcttaaagaagcggcgattcacgggaatggggcgcgcccacccgaatccggccaccagaatcaaaatggttccgaacggatcaaggtgtttaatgggattcagcgtcagtcttccttgttttttcgccgtatcgtcaccgaatttgtatgcgacataagcgtgggcaagctcgtgcatcgtaaacgacacaattagcgtgatgacgaggtatggcattaaagataacggataatataaaaaacggtccaagtgagatatccctctttctcaaaatgcaagaatttactttattcagtatactataagaagcctctttttctaaagagaggaaacgagataaaggaggattcagcacccatgccatacgtaactgtcaaaatgctcgaaggccgtacagacgagcaaaaacgcaatcttgtcgagaaagtaacagaagccgtaaaggaaacaaccggtgcttctgaagaaaaaattgttgtctttatagaagaaatgagaaaagaccattatgccgtcgcaggcaaacgcctgagcgatatggaataatctctataaagccggcgcttcgcgtaccggcttttattatccctattgagccagcttcgcaataatcgccaagaacgtctttttctcttcggctgttaaacgttcaaacatgccatcaatcagctgctggcggttttcgatcatttgttcagccgctccccggcccgattcagaaagcgtaatccatacagtgcggcggtcattgttatttctcgatctctcaataaacccttcctgctctaaatgattcagagctgtggtcgtggcagagggagacagtgtgacctccttcaaaatatcctttatggtgcagctcccatgtctgtatatgatccgcagaataaaccctcttacattattcacgtgtttcggaacggtggcttcatctaattgcttcgtgcttttcaaatattttgtaagtgcgtgatccagcaaatttgcttccagtttgtcatggtccatgtaaatttccccatttcgagatgcattcataacatacgaacgatatgatttacttattattttactgattccgaatagggaaagtcaaaaaagcaaaatatgaattcacagcttttatcctacatgcctcgattttccacctgtttcacaagcttatctttaaatgtctgaaaaggaacatgttcattctgctgatgtccgaattggcggacgtttaccgcattctcctgctcctcatgatctccaagcaccagcacgtacgggattttctgcacctgcgattctctgattttatagcccagcttctcattgcgctcatcaatgccggctcttatccccacctgcttcagctccgcctgcacctttctgcaatagtctaagtgaacgtgcgaaaccggtatgatttgaacctggaccggtgcgagccagactgggaaagccccgccgtaatgctcgatcaaaataccgaagaaacggtcgatcgagccgaaaaccgctctgtggatgacaacgggacgaaccttttcattgtgttcgttgatatatgttaaatcaaatttttccggcatttgaaaatcaagctgaattgtcgcacattggtggctccgtttcagggcatcttttatgtggaaatcaattttcggcccgtaaaacgccccatcaccttcattgatctcataagagaggccaagctcctcaaggacgcgtgctaaggcacgttccgacgcttcccaaaggctgtcatcgcctaatgaatcctccgggcgagtcgaaagctcaactgaatactcgaaaccaaatgtccgatatacctcatcaatcagccgaatcgcttctttgatctcactctcaatctgatcctcccgaacgaaaatatgggcgtcatcctgacagaacgtccgaacgcgaagcattccgtttaaagcgccgctgtattcatggcgatgcacctgtccgaattccgccatgcgaatcggcagatcccgataagaatacaggctgtttttaaagatgagcatgtggccggggcaattcatcggcttcattgcgaatcttgtatcatccacttctgaaaagtacatattgtcgcgataatggtcccaatggcctgactgctcccataaccgctgattcatcataaacggcgtacgcacctcatcgtagccggcatttgtttgcagctcacgcgagaagcgctccagctcattgcggacaatctgccctttcggcaaataaaacggcatccccggcgcttcttcagaaaacataaacagccctaactgtttgccgagcttgcgatggtctcgttttgccgcttcttccagcatatgcaggtgcgcatccaaatcttttttcttttgaaacgcaaccccgtacacccgctgcaggacttcatttttactgtctccgcgccaataagcgcctgatactcttgtcagtttgaacgccttgatcatccctgtagaaggaagatgcggcccgcggcacaggtcaacgaattccccttgctggtacagtgtgatatcctcccgcgcggaatatcctttaaaatctcaagcttgaaccgctcggctttttgtgcaaacagctcttcagcttcttcgtaagaaacctctatacgtttgatttcaaggttctcatttattatgtttttcatttctttttcgatggcctctaagtctcctgatgccaagcttttccccagcttcatgtcatagtagaagccgtcttcaatcacaggccctacccccaatgacacttcgccgtacagccgttttactgcttgggccagcacatgcgctgatgtgtggcgaagcacctgcaagccttcttgtgaatcgagtgtaacaatcgaaagctcagcatcctcctccagcttgaaactgagatcaacaagcttgccattgacctgacctgcagccgccttcttttgcagactggaactgatagaaccagccgcttctttgattgtgatgcctttcggatattcctggatctgtccgtccggaagctgaatgtgtacatgtttactcattttagaacactccttattcattgttgtatataaaaaaacacacccgtcccgcagatagggacgagtgtgtgattaacccgtggttccacccaagttcccgacaaatacgatattgtcggctcggtgctgtaacgcagcatagacggcattggttacttcagttccccaatgctgctccaaggcggtaaatgatattcctaagctgggaagctctcacctttccttccctctctgaaaaccgtaactatcattcatgtccttttcatcgcatgtattcaattcataaaaaaacacacccgtcccacagatagggacgagtgtgtgattaacccgtggttccacccaagttcccgacaaatactatgttgtcggctcggtgctgtaacgcagcatagacggcattggatacttcagttccccaatgctgctccaaggcggtaaatgatactcctaagctgggaagctctcacctttccttccctctctgaaaaccgtaactatcattcgtgtccttttcaacgcatttatgtagttcatataaaaaaacacacccatccctctaaaaagggacgaatgtgttgatcatccgtggttccacccaaattcccgacaagcgctatgttgtcggctcggtgctgtaacgcagcatgacggtatcggatacttgatttccccgatacggctcaaaggcggtaagctgctttccctgcgttaggaagatctcagctgtccttccctctctggaaaccgtaaaaagcatctcgtgtccttatcagtgcctgttgtttcaataattttttatatcttactatatattcccacaaagcgcaatcagtgatttacatttttttctgacgcagcagttccgttatgggcagccagaaacagccatacaagcaatgcagcgaggctgtatgccgctcccatcatcaaaaacgtaaacccggcaccggcataccaagtggcggacagatgaataatcaccccggttatcgctacgccgaccaaggctccgatttgccggtttgcatttaacgccgcaccggcgatattcgcatgtctttgcccggcagcctgcatgatcacagttgtcatggcaggaactgtaataccggtacagaggttcataacagacatcaacaccgccagctgccaataaggaaaatccggagaaatcagcacaaacaacagcaatgcaatgatacagctgaccgccattgatacaaacataagctgcccggcttcaaaccgattcgccagacgggcaaacagcagattgccgatcacgaagaccgccatcatcggcagcagctcaactccagccataaaggaacttgcgcctcctgcttcctgcaaaaaaaggctgagcataaacatgccgccaaaaagggcgaaattcagcaaaaacccgataaattgggcagctgagaagcgaccgtttttgtataaggacgccggcaggatgggtgcttttgcagaaatttcccgcagcaaaaacagcacaaatgccaaaatcgctgcagtaaatgctacaagaatcactggcgagcgccagcccgctgaaggcccctgtatcaaagcataggaaagaaacccgagagccatcatgccaagcagatgcccgatgatgttcacgcggctgctttttcccggaacgcggctgaggattcggtaagctgaaatgagcgcagcagcccccaacggcacattgatcagaaaaatactctgccagcccgccaactgtaccagcactccccgataaagggcccgaggcctgaagcggcggaaacaagcgcggcccacagcccaaacattctcgcccgcacccgctcatcagggtaagaggcagccaaaaggctgagtgagcttggcataaacaatgctgccccaattccctgtataaggcgtccggcaatcagcatctgaccatttatagatgcagcgcatagacaggaggcgagaacaaaaatagctaaacccaggatatagatcgtcttcgagccgaaacggtcggccaaggctccgcccgccagcagaagcgacgcaaaagtaagaatgtacccgtccacaacccacgttacacctgaaagtgacattgaaagagtgcttttcatatcagccatcgccacattcacaacggtcacatcaagagttgccatgaggaaaccaagtgcgagcacgatcagcacggatatgcctgttgatgatgttgattcttgtatagacccgctatttttcattacaattgccctttcacttgcttgattacccaatcatctattttttcaagatcatacaattccccgactctgtccataacatgctgcaaggattcttctctcataagattggaccatttatcctcgatttcccccatgactgtctccagcacacagtgactttcaccctcaaatacagattgcagcaggcctttcccctgatacatcgaacctctgccttcgaccgcttgataaacatcataaagcgtaatgtcagccaaaggcttcgtcagggtaaaaccgcccttcgtccctggcaaggattctgccaaaccggcttgaaccaatgttctcatcagcttcttcaagtaagacggagacacacgcaatcgctggcttatagcctctgacgtcaaagaagcctgtaccggcagccgtgacagtaacagcagcacagaaaccgcctgctccattcctgatttcattttcatcctattcactcctgattcattatggataactattatccataatgaatctcttagcagcttttgtcaataaaaaaagcaaaagaaacgattcatttcttttgcttggtatggttaacaaatctgcttcagttcctctatgtattgaagcgcttcgtcatattcttcatttgtatatttttgcttgcttttgatggtaaagactttttctttcttttcctcatcctcaagcccgtcaaagtaaaggatcgtggaaaccagctctaaaaaccgtgatgaacggctgtttacactgtcgatatagcctttcatatccggcatgtccagatcagcatggtctaaaaatgcggagcctgtctcagtcagcgaataccggtattgaaagtagccgccctttttttccttcacctcatgcagaaatccaaggttgcacagctcttcaatctggagcgtcagttcctctgaatatggtccgtaaaagtgaaaatcatatttctcatagaaaggaaactgcattttcttggcgatataaatcattttctgcagcttctttcgcccgatgatttctccagaatccgagaacaccttcatcagttttgcatgttctttcaacaaattcccgacatctcctttttccttctttccaatttctatgtcagtcccagcagctgccggattttcattttcgcttccggatgttcagagccgtcgcaaatcaagtcctttggatagtacagcttgtggtccgtccgccgtttacctgagatggattccacaatagccgactgcctggacagctctttaatttggccgttttgcgtcaagagatggatcggcagacgctcctcttcctctcccggtcggtaaaaatcgtatggcagatctgatgaagaatcaacgaccaaataatagctcggatcgattcccgcctctttgaacaatgaagtcagctcaaaataagccgacatttcttcattcggattgaattcaacgtattggaacagctggcggttaatgaatctgcggcacaagtcggataaaatcgcgtcttcttcatcctcccaggcctggaagtaatacaaaataatagattcatccagctttacataatcctccagtgtcaatttcccttcaaaaatagaatagaaatgaaccggagcgtgagtgaagacatagccttcatcgtgcagctgcttcgccctgtgaagaatcttcgttaaaatgacctctgcacttctagtcacaggatggaagtagacctgccagtacatttggtaacggctcatgatatagtcttcgacagcgtgcattccgctttctttaatgacgatctgatcctcgcgcggccgcatcacccgaagaatccgctccatatcaaaatggccgtagctgacgcccgtataatatgcgtcgcgctgcaggtaatccatgcggtctgcgtcaatctgactcgaaatcaggctgaccacttgcttgtttttatatgttttggcaatgacttcagcaacatcctgagggaaacccgggctcacctttctgagcacctgattaacctccgtgtctcccaaaatgatacctcttgtaaaatcctcgtggtcaaggtgaaagaccttttcaaatgaatgcgagaacggcccgtgcccgaggtcatgaagcagcgccgcggccaaacagagttcgcgctcactgtcatcccattcagggcggcctttaaagacgtcatcaaccattcttctgacaatttcatagacaccgagagaatggttgaaccggctgtgctcagccccatggaacgtcaaataggtcgttccgagctgcttaattctgcggagacgctgaaattcacgggttccgatcaaatcccatatcagcttgtcccgaacatgaacatagcggtgcaccggatctttaaacactttttcttctgataattttccatttggatacgccatcgtcattccctcttttttttagccgtgtttctattatatcgactctattctttgaaaacatccttgaatttgcccggcgatttgttccatcttcatgaaaaacacatcttgtgaagcaaaaaagcctgacctgagggccgaggctaagaaaaaatatgtttttacttttttattttcttttttactttgtcaatcagctcatcctctgtcggagctgacagcgggcgattgttcacaaaagcaaatgattttttccgtccgggcccgcaataagattggcatcctacctcaacctttgcgtccgggtccacttctttcaaacgcggcagcaatgttttgatattagtggcttggcaatcatcacacactcgaaattcattagccatgacgtacgcttcccttcatttctatgttcatctatgtgaataacctaaaatcacgtttcaaaaaaaaatcacatcactcttcattttacaaggattcgactgttcctgcaagccgctccatccttcgtatctcctattctttcagccaatttgtataaatattttccaacctggacattctaataccatgaaaagaaaaatgggagttgagataaatgacaaaacagcgacaagacgcttggtcagaggaaaacgatctgcttttagccgaaacagtgcttcggcatgtgagggagggcagcactcagctgaacgcctttgaagaagtcggcgataaattaaaccggacatccgcagcctgcggattcagatggaacgcagtggtccgccatcaatatgaaaaagcgcttcagcttgcgaagaaacaacgaaaacagcggatgagagcgctcggaaacgggcagcctgcgaaaaaaagattattatatcagcctcctgccgttgatcctgaaatcattcaagaaaccgcagcagaagagccggttaaaatggaaacaccatctgtcgaaaatgagcaacctttaatgtctggcgaacatatgccttttgttgatgaaagctttaaggaagagttagctagtctatcacacttattgtctcctcaaacgcctgcagctgcgcctgagatgacgatgaatgatgtgatccgcttcctgcagaattacgaaggcaataacgagcaatcatcagcattaaaaatggaaaacgagcgtttaaagaaagaaaatcaggaattgcaaaacaaaacagagcagctagaggcagaagttcaaaagcttgaaaaagaccaaaaaacgatccaagaagattatgaaaccttggtgaaaattatgaacagagccagaaagctagttttatttgaagaagatgaacatgcctctccgtccttcaaaatggaccggaacggcaatttagaaaaattagcggaataacatagaaaaatcccaagacgggcagctgttttgggattttcgccatgtacaaaatccccttttctattgagaaaagagaatttcctcattttgcagccggatcagctattcttgtaaaatgaggccaagcttatgtgaatctattaagacatgtgagctgcctcggccgttttttgtttccgaggcgcagcagaaatgaccaaaagccccagcatcataagcgcaatgcccagccacgaggaaggcgaaagcatttcccctatgaaaaacacgccaagcaatgaagctgtcagcggttcagctaaagacagcgtgactgccgccgaggccggaaccccggtaagccctttcgcaaacaaaaagtatgcggcacatgttgcaattaacccgatgtaaaggcttgttcccagtcctctaggggtccatatccacgagatatctgactgccataatagcggcgtcagcaagatggcgctgatcatgaatacaacggcggaggtcgctcgcggaggctgggttttcatcatcgctttactgatgagcgtatagcctgcaaaagaagcacccgctccaagcgccataagaacaccagccacatcaatccgaacattggaactgtcggaaaacagaagccagcaacccgctaaagccagcacagtcgcaatccaccaagagtttcgcgggcgtttcttcaatacggcccattcgagggtcccagcaatgataggcgcactgccgatggcaatcacagttcccactgcaattcccgtttctttaaccgctgtgaaaaacagcggctggtaacacgccatacaaacagcggctaaaaatacgagcggccatgaccaatttttcacgtgaagctcccggctgatccaaaccgcaagcagcatggcgcttcctcctattaataacctgaacgccccaaatgccagcggtgtggcgctttctggagccaacgcctgaacggttcccgtagttccccagaaaaaagccgccatcaatacaaaaaggctgtaaatattccccttcatctgcctctcccctttaatatggatgctgatgtcattttatcgtttttctttttgtcgtggttatctgtatgtaagaaggatttatctgaaaataagattattggggtaaaatgccgcttgagataaaaaatgcatgccgtcatatacagccggcatgcgaagaacgttcacccaaatacctttgcattccgctcagccatccggatgaggtttttctcaaattccatttcctcatcaatggacagtccagctgaataaagatgggtgcttaacgcttttaattccgtcaataaagcgaacattaagtcttgtacggagatgtctttttgcagaagctcacttaaggacgccatcgtttccggacgtatttccggatagacgccttttttatcgttttgtttgtctttcagcgccgcttgatagaatcgtctgatcaagtcggccctttcactgccgcttttatccgcacagagataaatttgaacagcgactccgccgcgaacgcgtctctgagagatgccggcaaactttttgccatttatactgaggtcatagctgccgggacaataagacccttcaatttcataggcttcgatctttgcgttgtacggtctcagcattcgtctcatcagctcgaccatcgcttcatatcctttgtctatatcgatgcctttcttttcgtcctcgaatatgagagagatatttaaaacaccgtcatccaatacgacggcaagaccgccggaattgcgtacgatcacacggtatccttcgctctccagcaaggagatgccatcctgcaaaaacgggaggcgtgtatcctgtattccaaggacaattgtatcgtggtgcacccatgagcgcgctgtcgccggcgacacgccttttccgacggacatgcacagcgtatcatccattgcgaaggattgcttcgcatcaaataaagggccgagactggattggtcaatgactctccatttcggctgcatcagtaaatcaatcggttggtttgccatctatgtaaaaccctttcatgttaggcttattgaacgaaaactattatatcatttcagcagctgtgattgataattgcttttcagcatcgtaataaaaatttctttattttttgtattctccatgagaggagaatgaatgtaagacagcttgcgctttaacgagaaatctttaatatgcagaattgagatttcgcggtggatcaaatccttatgcagtacgcttctggatagaaccgaaagtcccatgccgttaatcaccgcttcctttacaccttgattgctgctgatagtgaacattgatttcggccgaagtccatttgaactgagtacatgatcgagatattctctcgtcccggagcctttctctcttgtcacccacgcttcgttctgcaaatcgctgatcgaaatctctttccgcccagccagcggatgctgatttggagcggcaatgcacatttcatcctccatgaacggttcaatttccagctcattctcgtttgtatgtccttcaatcagcccgatatcagcctgaagcatccgcacacgctcgctgacctcctctgtattgccaatcatgacatcgaggttcagctctggatacagcttttgcagctgggccaatagcggcggaagaatatactcaccaattgtaaagcttgcagctattttcaattcgcccttcacatagtgatgatgcgcatagatttcagccttggcttgttcgtagagaaacaccatttgctttgctctttgatataaaatgtctcctgtcggcgttgtcgtaaagtgttttggcgacctgttcagaagagccgtttgaaattctttctcaagatttttgatatgcagactgacgctgggctgggagatcatcagcttttctgccgcttttgtgaagtttttttcttctaccaccgctataaacgttttcagcacgtcgtaatacaaaaaccccacccctgtcattaatgaaatatatggttatgattagttttctttattgtactcatatcatccgtcttggtaaagaagggctatacagaagcgcaaaaaaggcagccctcggtcgagagctgccatcgtcttcatttttattacagtgcttgcgccgctgtaattaatgcgagattgtaaacatcttcagcgttacatcctcttgaaaggtcgtttacaggcatatttaaaccttgcaggattggtcctaccgcttcaaagttgcccaaacgctgagcgattttatagccgatgtttcctgcttcaaggcttgggaatacgaatacgttagcgtcccctttgatttcggaatccggcgcttttttctcagctacagatggaacaaatgcagcatcaaattggaattcgccgtcaagtgtcagttcaggcgctttttctttcgcgattttaactgcatccgctactttttctgtttcatcagattttgctgagccttttgtagagaagctgagcattgccacgcgaggctcaatgtcgaacatttttgccgtattggcactttcgatcgcaatctcggcaagatcttggctgtcaggcgcaatgttgatcgcgcaatctgcgaatacgtattgctcttcccgcgagccatgatgaacacgcctgaagtctttttcacgccttcttttgttttgatgatttgaagagccgggcggacagtgtcagctgtcgagtgagcagctccgcttacaagtccgtctgcaaggcctttatacaccagcattgtaccgaagtagttctcgtctaataacgctttgcgagcctgttcttctgtcgctttgcctttgcggcgttctacaaatgcttgtacaaggtcttccatgccttcatatgtatgaggatcataaatcttaacgccgtccagcgtaaggttcaattcttttgcttttgcttggatctcattttcattgccgatcacaatcggattcagcactttgtttcctgcaagcttgctgaccgcttctaaaatacgctcgtctaagccttcaggaaatacaattttaacgtcttttccagctactttttcttgcactgttgaaaataaatctgccacaataaaacctcctcaaaaagttacaaaaacgctttcttttactagcatactcttcttccaatcaaattcaaacagccaactttcattatagcgctttcataaaaaaatcttatttttctaactaatttaagtgactcaatcttcccttataggttcttctattttgatggagttatacggaagggatgttcaaggtttctccacagtagaatcggataaactatggtatagtgaaggcaatcatgaaaagataatgggagtgaagataaatgagtgaacagcaaatgacgaatgaagctgcaaaaacgcttgacggctggtatgcgcttcatgatttccgcacaatggattggacttcctggaagctgctgtccagtgatgagcgccaatctatcatacatgaattcaccgggttgcttgaaaaatggggcgtagcccaaaaagaaggaaaaggatcgcaaactctttacagcatcgtcggccaaaaagctgattttatgctgatgatccttcgtcctacaatggaagaattaaatcaaattgagcttgaattcaacaaatcaagacttgctgagttcaccattccggcatactcctacgtatcagtggtagagctgagcaactacttggcaagcggtgacggcgatccttatgaaaatccgcatgtgcgcgctcgcctttaccctgaactgccggaatcaaaatatgtatgcttctatccaatggataaaagaagatccggcaatgacaactggtatatgctttcaatggaagaacgcagaaacttgatgagaagccacggtttaatcggccgcagctatgcgggcaaagtcaaacagatcatcaccggctctgtcggctttgacgattacgagtggggcgttacattatttagcgatgatgtccttcaattcaagaagctagtgtacgaaatgcgttttgacgaagtcagcgctcgctatggcgaatttggttcattctttgtcggcaatcacctttcgcttgatacacttcctcaattcctatatgtataatatcccctcccgccctatccggcgggagtttttcaatcctcctttatcagaatttaaataaaatttgctattttcttcgttttttcttacgatgtagataataatccaattttttcaaaggggtgcagttatttgtcaaaacgaaccgcatttgttatgggagccagtcaagggatcgggaaagcaatcgctctgaaattagcagaccagcatttttccctcgtcattaattcgcgaaatttggataatattgaatctgtcaaagaagacattttggccaagcatcctgaggcgagcgtcattgtccttgcgggcgatatgtctgaccggcatacgagagcgggcatttttcaggaaatcgaatctcaatgcggacggcttgatgttctgattaataatatcccgggcggcgcgcctgatacatttgataactgcaatatagacgatatgacggccacgttcactcaaaagaccgttgcctatattgacgctatcaagcgtgcttcctcactgatgaaacaaaacgagtttggcagaatcatcaacattgtcggaaatctgtggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaggaacagattgcttccgggattccgatgaaacgggtcggatcagccgaagaaaccgcagcgctcgccgcgtttcttgcctctgaggaagcctcctacatcacgggacagcaaatttccgctgatggcggcagcatgaaaagcatataaaaacatcccgctttttagcgggatgtttcttgtaatgacccgaacggcaggttcagcttttgaatccgcgtgacaaattcccgcagatcctcctgcttcgacaccattgagattctgacatgcctttttccgttgcttccaaaaatttcgcccggtgtgactacgacatgggcatgctccagcaagtaatcggaaaattggtgagatgtctcaaacgtattcggaatttcagcccatacgtaaaaggttccttttggcttttccatcttccagcccagttccttttcacaaagcgccgtaaaaaagtcaattcgttccttataaattcgtttcaacgattccgtatgctccggatctccagaaagcgccgcactcgctgcctgctgcagcccgccgaacatgccgacaaatacatgatcctgaaattcattgacggcctgaatgatcctttcgttcccaaccgcaaacgccattctccagccggccatgttaaatgtttttgaaaatgaataaagctctgctccgacagttttggcatcctctgcctcaagaaagctggccggtttttgatcgaattcaaacgccccgtatgcaaaatcatgaatcaaatggatgttatgctctttcgcaaaagcagcagcttttgcataaaaagccgcatcagccacagctccagtggggttgttcggatagtttaaaaacataagcttcgctttttccagcacggctggatcaatcttttcaaaatccggcagatagccattttcttcatacagcggcatttcgtaaagctcagctcgcgccatcgtaatccctgataaatattcagggtagcctggattcgggactaaagcgatgtctcccggattgagcaggcattgtgtcagcacatacaaaccggctttcccgcctccgaaaagcgcgacctccgtttcaggattgattgtcacgccgtattctcttttatagaaagcagcgattgcttccttcaaaaaaggataacctctgaatgggccgtatccatgaaatgaaggattcagagacgcctcccgcaaagcctcgacaatatgcggcggagtgggaaggtcagggttcccctgtccgagattaatgatatgggctcccgttttttccatttcctttaccttttgaaaaacgagagaaaactcctgccttggaagtgtcttgatgacatcggacggtgttatttccatctaaaagactcctttttgctccgttttgttatcccgttccaaaaacgatttgttgacgagcttcgtatgcagaaacaaaccgcatacgatcacgacaatcagccccataatgaccggagcgcttaggatgttaatgaacattgaaccaatagaaatgcataatccgatagacgcttcggccactgaaaaaatgcgcccttgaatctggtttgccgcattttcctgaaccttcacttttgcaagcacttccccgtattccatcgcgatgaaaaagaggatcgccgcgatgacagaaacagcgaatatcggtgtgaataaaaacagcgccagcgagacaatggataaaacggtaaagtacgtcaggcctctattgttgttaaagccccatttgctgacaagcgccgctccgataaagccgccgaagccgatgcagaacgtgagaataaagttgccgatttccccgtcacccagaaagcggctgacaatcggaaaatagctgtacacaactccccacagcaaagccatcgtaatcatcgtaaacatggcgtttaatacgaatgcattggttttgatttccttgagtccttccttaaaagactgaaaggcctctttaatgttttcagattgaatcggcacaaattgcagcttgatacggctgataaaaaatgccgaaaccaggtatgtcacaccgttaaaggcaacagccagctctacagatccgcctaacagaaagagccctccggcagccgccccgacgataatggaaatggttgtcgcttttgcaaataacgtgttgatgcttttaatatctgattctaaggacgacatgacagcgagacgggcgggattaaaaaacacgccgcttccataagaaataaacagcagggccagaaaaatcagcggatactcgccttttggaagaaatgtgagccccaaaaagatgatgcctctgatgatatccgtccacagcatgatcttaattctgtctaaccggtcgaccagaacccccaaaaacggctgaaacaccatcggaatgcttctgaccacgatgaccccggacgtcacccaataatcgtgataatatgtagacaaaatgagcagggcagggagaacacaatagtctcccatgaatgatagcgcctgcccgtaaagcaagtatttagagttgggtttcagctgtttcatactggcagcacatactttgccgtcagcttcgcatgctgctgaatttgtctgattgattcagccacatcctgtgaattactgcctttcagttcaaatgcagcaatggaattgaaagcttcaaacaatgtcaaatcaactgaagttcctggtgctgcggccgaaaaagaaacgatttcagtatccccttttaaaagcccgtcaggcagatcgatcgcttcaatgaccaaatcctcagcagtttctggaatctggccattttgtttgaaatgctgcgggtacaaatggcagtcggcaacataataaggctcttgatccaataatccgtccggcagatcggcgtcttttccgaaacaaaggacatctaataataattgcgccatatcaaggccaaagacctttttaatattggggatcatattccagccggcgaatctggctgccgattcaattaaacccggttctctgtttttcattagcttgatctctgtatgtgttgcgcaattttgcagtccaagcccttcatttgcctttttggcagcttcgacaattttcttttttgcctcttcatccagaatggacggcgtaatgtgggatgtctctgtaaacccgatttgcggcgttttatcatgaatggcgatcgggaaatactcaccgtcagccatgatgccttctatactgatatagtcggagtacccttctgtttgataccagtctccgtactcaccctgtaaaaattcttcagcgataaacggcgcttcaaacgtaaccgcctttggcacgttaattgatttcagatagtcattgactctgttaaattcatcttctgccgtctcagtgtccgtaatcagcgttacaccgattgaactcgctaagtatgtaggctttaagataagaggtgtgccgatctcttcaagagcagcacggaaatcttcaagagttgtgactcgtttatttttgatcgatttgactccggccttattaaaagcgtccctcattttatttttatctctggcattttcggctgcctgcacgccggcacctctcaggcccaggcgttcacaggctttcgccatcggagcaatgaataattcattgtttgttgtgatggcatccgccccaaacatttcggcaaccttgacgatttgctcgacgacctcttcctcaggcttgtcatgatcctcatgcgcccaataaatggaatcaggatgctcaaaatcagctaaactcttaaaatagtctttatcttttatgaccgcgaccgagtatttttcaatcaatgctgcatgggaggctgtaattgcaaaaggtcttggaataaagctgaccaggttatatttttcagcagcgcttttataaaacatgtgcggcgggcagcctccaagatcagcgatgaccaatactgtttttctctccatatgtaaaacactccttctctattgtgcggtgtatcctccgtctgcggtgatggcgcttccggtcatatagcttgataaatccgaggctaaaaacagcatcacgtttgcgatttcttcaggtttcccaagcctcagcagcggatttaccttcgccttttcttttttgatctcttcaagtgtgccttcattattttcaaggaatgatttttcattcagcggtgtgtcgatgatccctgggcatacgcagttcacgcgaatttgatgcttcgcataatcaacagccattgatttagtcagctgcaaaaccccgcctttgctggcgttataggcaggaatatcaggccatgccacgagtccgccgacagagcacgtattaatgatgttacccttgccggcggccagcatatgcttaagtgcatgtttgctcattaaaaacgtgccggtcaaattgacttgcagcaccttgttccaatcgctgagctccatctcgtgaataggcgccacgatttcgatgcctgcattattaatcaagacatcgagcccgccaaatgtatgaaccgccgattcaactgcgtgctggcaggcagcctcgtctgtgatgtccgtttgcacaaagtgcagcctgtcattattttcttttcgtaccattgcttctccctgcgcttcgtcaatatccgccacaaccacattggcctgctggcccaaaaaagcctgaaccgcagcataaccaatgcctgatgcgcctcctgttatgaggacggttttatcggtgaggttcatgatcattcatccgccttcattttttttgcttttgctctgttgtagcgcggcgggaagaagatattaatcgattttgattctttttccgaacggttgatggcaccgtgatcttcacgaggctcacagaaataggctgtgccgaatttcatctcgactgtgcagccttcgaccgtcatgtcatagccaccgccgatgcagatgccgatttgttcattccgatgtttatggaaaggcatttctccgccatttccagggattttggcaagcataatttctacccaatcctcaacaaagaacgtgacttccatgcccggcaacaggtctcttgttttgaaaatatccaaaaagtagtcctcaggacttgtatatgtttcatcagctttcagccgcttgatatcaatagcaatcacttcttggtctgtgtcgtttcttgccccgtgaggcacatgcggcggcgcgatataggcagattccaaggctgtcatttttcttgtcacatctccgacagtcatcatcagctcgccagaaacgaccatgccgatttggacctccttatgctgatggggttcaacattggtatgcggcgggacgtaagacattaatacttcagtatcccctcgtacggttgaatactgcctcactccgttttcccattcaattaatttcggtgtcgggaaataaagctcctgcatatcttctttagttttcatcatcaccgtctccttttccaaataatgaccagctcattggaatgcttttgaatgtttttacaaaggttagcccgtacttttgccgtgcaagctcattggttaaggcaatatcatacaagccttcttttacttttcttgcggcttgactggttgaattgactagtttgaaacgaacatctttgcgggtaaaatattttattaaattaataggtgaaggatgtgaaacaataacagatgtatcaagcatatcgtccctgaattcaaaatcaggacgaacagccaggccgtacatcggtgtatcgcacctgaagatctgcaatagctgcaaatccggcctcatgtagaaatgcttaatgccatcgtaagcatgtgggacgatggtatattccagcgggctttggagcgtcctttcgatgcatgattcaaaagtatcatgcaaggacaatttactgttcagcccttgtagaagagtaaaattggaaatgaaatgctttgctgcgtactcactgcttgtcccctcagggccgagcgtgttgactgtaatgagtttggatagtgaatcagttcttttttttgtctgaatgctattatccaatataatcatgagcaccaaccaatcttttaaaattttaagtaaattttatccagcggaaattgaactgtcaatgttttttgaaaatattgataattattcccatacaaacaaaaaaaccctttaaaaagggtttttaattataggaatttagaaactttgtttattgagataaggactgatcggccttctgctcaagtttgccgtactttttatatgcgaatacactgagcacaaatccgaggactgtgatggctgcgcaaatcaatccgacagctgcatagccgtatgccacatagacgggtcccattaaagcagaacctaatgtcacggccagattcgaggcgaggctgtaaaacaccatgacttttccgcgatgacgctctgagcagtcactcaaaatggtgctgagcagcgtcaccgtcaaactttgcattaatccccaaataaataggctggcgattaacagaaacatagacgccggcgcatatggtaaacacaccagcagaacgctgatgacccccagcgcaatcaaaagggagcgcatttttccgatgcggtcggctatctttcctgtaatcacactcatggaaaacccgattccataaatcatgataaataagcccgcagccgtgtttcctccggtaaaaacgtcctgaagataggtgcctaaaaaggaatacataccgtaaaaaccaatcatattacaaaaggttatcgtgatataaacaggtacacgagggactttcagcgcatcccggaatgttcctgccggctcttctatttcttccttgccgctgtttttatgttgggcatggcggcgcatttcaaggagaatcagcaggacaactaaaacgcccatcaaggcgaaaatccaaaacgtccatctccaatgcaggacgccgccgataaatgatccgagcggcactccgaaaatcagcgccagcgaccagcttgaaacgatcagtcccatcaccttgccccggtatgtataagggacacgatcaccgacaactgcgtaagcggtcggaacaaacgctcccgcagccaatcccgaaagcgcccggcctaaaaagaagaaaaaaatattttgagctaaagcgcatatcaccgttcctatgataaaaatcataagcccggccaataagctcagttctctggagtatttatcgcctaatggaaccaaaagcggcgcaccgataaaaatcataacgccgtaaatactgatagataatgcaaggacgctgacatctgagctgaaggcttttgctaaatccggcagcagcggtgagattacaagctcttcagatccagccgcaaatacccccatcgttaaagccagtgccaacaataacggaaaatgatgttttgttttgatgtcattgttttgattgctgttcattctttctcaaacacctcttccataatcttcttatcataaagttgtattatagtttagcattgttttttcactatttacaattcgaacgaaatatttataagttttattgttttcatttaaatcccattatatatttctatatttcattctaaaaacacatgaggatgtaatgcgtagaaaaagctctccggcctcccggagagctttttctattgcgcctctgtctgctctttttcaatcggttcatgatttatacgctttttgatgcttagatgatagtatgcataacagaaaataatgatcggcacaccgcagtataagccaattctttgatccggaatgaaaataaggctgatcaacacgcagccatataaacaaaatccgagaatcgggactagcggataaagcggcgttctgaactccagatcattcacatttccgccttcagcaaggaaacgcctgcgaaagaaaaattgcgacgcacaaatggacatccacgcgacaactgtcaccatgcccgagattgagatacaccataaatacactgtttctgcagccatgacacttgtcagcagcgaacagcctgaaatgcctagcgtaatcagcagggcattcatcggcacgcctttttttgtcagtctggtgagaaaggagggacccatttgatttgatgaaagtgaccacatcatacgcgacgccgcatacaatcccgaattagcaacagataaaatggccgttaagatgacaaagttcatgatatctgccgaaaatgggatgccgatttgatcgagtaccgctacaaacgggctttcaatcacccccgccgttttgtacggaaggatggcaaccaagacgaacatagcgagcacaaagaaaaacagcgtgcgccaaataacatttcgaatggactttggcagtgttttttccgggctttcactttcccctgccgcaatgccgacaagctccgttccctggaacgagaagtttaccatgaccagcgtaaacataacggccagcaccccattagggaaaagccctctatcagtcataaagttagacaaaaagggtgtctcctgtccgcctttaaagtcaatcaagccaaacacagcggctccgccaatcacaataaataatatgatcgccgccactttgatgcttgaaaaccaaaattccatttccgcaaagcttctgacagagagcgcattaatcaaaaagatgacgatgccgaacacgaggcaccatatccagatcggaacggagggcagccacctttgcatcaaaatgcctgctgacgtcagctctaaccccactgtattcgcccagctgaaccaatacagccagccaatcataaagcctgtcgacggtcccagaaatttagtggcgtaggcctgaaacgatccggccaccggcatggcaacagccaattctcctaaacaaagcatgacgagatacattaaaaatccgccgatgatatacgcggcaatggcgccgagcggtcccgcctggctaatggtaaagccagagcctagaaacagcccagtgccaatcacccctcccaaagcaatcataaacaaatgcctgcttttcatgctgcgctgcaattcatttttatgattctgcatcatccttccccctttggttcttttgccgtgatggtcatccggtagctttgcaaaagatgaacggtggtttgctgtatgaggagaggcaatacatgaaatgtgtacggtttatagactcgttctgtccatttatggccgtcttttccgtacacgcccatattaatggatggaatattcagcttgcgtatgtctttgaacggaatggttccaatcatattccacccagggaagttcctgataaaagaatcaatttcgccatcggtttcgtgcagtgataaaaaactgccgtctgccaagtaggggaaaaactttttgaagacaaatgtttcgcctgtcgattcagcggttttgtcagccgcttctttaatcacatgctgcaaaagctgatctcttgcgctatcttctttcaaatagttatgcggcaggtaaggaggtgcgtaaaatagaatgacttttgcgccttgatcggggtcaagcttttgaagctcttcgattgcctgaaagcatctcatgcgaagttcaaggtgctcgttggctttgaatgtctgctcgatacactgctcgggatctatcccccggtttctcagcttttctaagtattgctccaggctatacacttgaatgccccatgataaatgtttctttggcaggttggctctttttgcatattcttcataataatctgataatttttgttctgtctctcggcatgcttcctcagtgacttcaataagcaaatccatcatttcttttgctgttctttcataaataaaacaattgaaatacaagctggtgctgacagccgtttgcacattataggattccttgttatcacgctgatacaaacaggatgggggcagaaccaactccccttcaaccttttctgccagatggatgttattgtggagacggcttgtgatttcagatgaaattaaatttgggtcaatccctgccagtgtattgccaacatggacttcacgcccgtaaatgtaaaagcaaggcagcagttttcccgcggctccggtatagatatatcttgtctgatcaccatcgtaaagcggggtaataaaatccgtattaatagcagccaaatagtgaagctgtttttctttttttagccggttcagctctgaaatgctggcaagaatgcccgaatgctggctctcctcatcgggattggccataaacaatacatttcccggcaacgtctcaaggttctccgaaaaatgcaggagattggctaaatgcacggcgatgccgctttgcatatcgacagatcctcttccgaacatccactcgcctgatttggcatcccgctgaacatcctgatcgaactcatagcggctgaaatactcggccaatttctcacaatcaaaagcgatatcctttaaagggccgaaatcttcgattccaactgtatccagatgggcatggtaaatgactgtattacggctttctccatgtcctttaataaacgcaaaaatatttttgcgattgtatgggtcattgggaatggcctgttcccacacatgactggggttttcctgaaaataaggatagctcgtgatcacttctttgatgaaatctgcttttgtcccttctccaacggtgccgttcacgctgctgaggctgaccagagatgctgtcagcgcctccactctttcagccggattcatgtgactgatttttgtatactgcataaattgtcctcctgatcaaaaagttgaaatcgtgcgatccgctaaagaatcgcacgattttatttctctcaaatcaaaaagcttcggacgttgttttggcttgcatatgaagaattaagtaatcgggaccgcctgcttttgagtctgttcctgacatattaaaaccgccgaacggctgatagccgacaattgctccggtacatcctctgttaaaatataggtttccgacatggaaatcctcgcgtgcccgttcaatgtgcgcacggtttttcgtcagaagcgcacctgttaatccgtattccgtgttattggcaatctccagcatatgatcgaaatcacgcgctttgcaaatcgcaacaaccggaccgaaaatttcttcctgcatcaagcgggcgttttcatcaacatctgcaaagatcgtcggctgaataaagtagccttttgaatcatcgccttctccgccggccaatagcttgccttcagatttgccgatttcaatgtatttcatcactttgttgtaggatgcttcatgaatcacgggacccatatacgtatcaggatcttctggattgccgacagtcagcgttttggtcagcgccacagctttttccaccacttcatcataaacatcctgatgaatgaccgcgcgggagcccgcagaacacttctgtcctgaatatccaaaggctgaatacacgatagaggatgcagcaaggtcaagatcagcgtccttgtcgacaagcactgtgtcttttccgcccatttctgcaattacccgtttgagccatttttggcccggctgcactttggcggctcgctcataaatccggcagccgactgcacgggaacctgtaaatgagacaaaccgtgtcttcggatgctcaactaagaaatcaccgatctccgctccatctcccggaatgtaattcagaacgccgtttggcagacccgcttcctccatgacctcgacaaattttgctgccactaccggggctgcgtcagccggttttaagagaatcgtatttcctgtcacaatcgctgccgccgctgttcccgccataatcgcaagcgggaaattaaatggagaaatgacgatgccgacgccaagcgcttcgtaatgatattgattgacctcgccagcacggctcttcaccggagccccttccttgagctttaacatttggcgcgcgtagaactctaaaaagtctatcgcttcagccgtgtccgcatctgcttccttccacggttttcccgcttccttcacaagatagcttgaaaattcatgctttcttctgcgcaaaatagccgctgccttaaagagaatattcgcgcggtgctccggtctttgttttttccaggaatcaaatgcctgcaatgcggcttgcatcgctttttcagcaagctcttgatccgctgtagacgcgtacccaatgatctcttctttatttgccgggttaatagaaatgattttgcggtccgtttcaattttttctccatttatgacaagcggataatgcttgccgagctgagtgtttacaaaggccaatgactccccaaatgcagttttattctttgcttccgtaaaatcggtaaatggttcgtgcgcgtatgtgactgtcatatgtagtccccctcgtgttatgaaatatatcttcgcatatgaataaaaatgcaagaatcatgccattttcttgtcttttgctgaaaaaacttgttgaatcgaacagaaatttgtctaacaggtgatcacctttctctttttccgatcttgaacgcaaatttattttgcgatttttgctctttacgcaaaaaacaaatgcaaaattattttgcggaggcttctcaaattacacccatccgcggaatctcgatgcttctgccgattttctgatgcccgtcatgtaagccgccaaacgcatatccactttatgtgttgccgctgtttgataaattgtttcgaacgagctgaccatgacgtttctcagtttttctgcaacttcttcttctgaccaataatatccttggttgttttgcacccattcaaaataagaaaccgtgacgccgccggcactcgccaggatatccggcacaagcagcacgcctctttcattcaggatcttagtggcatcaatggttgtcggtccgttcgccgcttcaacgacgattgacgcctgaatgttatgtgcgtttttggctgtgatttgattggagatcgcggcaggcactaaaatatcgcaatccttttcaagcagctcctcatttgtgatgacgtcagtaaataaattggtgaccataccgaagctgtcccgtttatcgagcaaataagggatatcaaggccgtctgggttgtagagcccgccattggcatcagaaatcccgatcaccttcgcgcccgcatcgtgcatgaatttggccaggaagctacccgcgtttccaaagccctgtatgatgatgcgcgcgttttgcagcttgatcccttttttcttcaccgcctcttcaatacaaatcgtgacgccctgtgccgtcgccgtttcccgtccttgcgatcctcccaaaacaagcggtttacctgtaataaagcccggagaatcgaattcccgcagccggctgtactcatccatcatccacgccataatctgcgaatttgtgtatacatctggagctggaatatcctttgtcggaccgacgatctggctgatggcacggacataccccctgctcagcctttccagttctccaaatgacattgtccgcggatcacaaataataccgcccttcccgccgccgtaaggaagattggcaatcccgcatttgagcgtcatccaaatggataatgcctttacttcctcttcattaacttctggatggaagcgaacgcccccctttgtcggaccgacagcatcattgtgctgtgaccggtagcctgtgaacactttgacgctcccattgtccattttgaccggaatgcggacagtgagcattctctgcggctctttcatgagttcatacatatctcccggataacccagcttccgaagggcttccttaatgattgtttgggtagacagaaataagttaagagcttctttttcttcatctttcgagacttgctttgctgacatctttttcacctcattgtttttttggccggctgtaatgtaagcgctttaaaaaatcagcccgccaattcctttctgcatcggattcacccttatcatcatgcaagatccgtaccagcttttgaatccacaaaaaaaaagagactgaaaacatctcagtctctgactacaaatctatcgattaacggggatcaatcaccagctgcgtttcagcataaaaactgccgattcccaaaccgtttactacatcgcctttaatcgtgtaagtgcctgcgcgaggaagagttttacgcaccatgacaaggtcaaattcggatgcgcctaacaaatcaagcgtaagcgggagtctgactgtttttccatcgtttaaaatctgtgtttctttcagtgttcttccattcactgaatctcttgtcgtagcatgaaacccgtcaggaaattgaaattctaccgctccgagagaaagcaccgcatttggtttatatgtcacttcaatatcagaagtggtccactctttcgtgctgttaattgtttttgcctcgattgatgcagactgtgcatgagcttggcccgaaggaagtaagattgatagtaaaacagctgaactgatgaataatgaagatacgaatgaagttctttttagcatgacatttccccctaattgattgttgaaatttggccagagcgtcctctgcagaaaaagcgctttttcataattcgcgaattaccagttctttttcttaaaaattaatctatcatcattttccatggaagtaaatgttttttaaggaatattaacacttggaattcaatgagaattacttcctgtttacacaaggttcaaatggacgatttctctctctttttctagtaacatctgcccgacattttctatcttttatcctattttaaaaaagggcaaaaaaagtcgaagatgcctctgctcttcgattgatcacgttcctatttttatctgaattcagtgttccagttaaaaccgatcgtctcatcattccacggaattcttttttcatcaggctgatccgggttatacgacatggtggtaaaatagataattgtcagcggtgtctctcccagcactctatatccgtgagccaccccttttgggattaataacagcatcgggttgtcttcgcccatataatagacgtccgtttctccttttgtctttgaatcctctcgaagatcgtataggacaacctgagcgtggccggttgggaagaaccagagatcatcctgcttctcatgataatgaaatgccttaatcacacccggatagcttttcgaccaagaggcctgcccaaaatgctcaaggagattctcatcgtcccggaccagctcagcaaaaaagcctctgtcatcgctatgcttcatcaattttttcaccttgactccatcaatcacacgcactgctcctttcctgcaaatactctcgtaacgcttcccgccagtggcgggggcggatgccggcttcttcaatagcccgatggctcagcacagagtatgccgggcggggcgttttgttcccgtattcctctgtcgttacaggcaaaatggctgtttccagcccgctttcttccataattgccgtcgcaaactcataccagctgcatatgcctgaattgctgacatgatagatgcccggcggatggctgaacagcttgatgaccgcttctgctaaatccttcgtataagtcggcgaaccaatttgatcgctgacaacccgaagctcttgtttcgtttcagcaagcttcagcatggtttcaacgaaattactgccgccatgtccgtacacccacgatgttctgatgatcgtgctgtcttttgtcgttaatcgtatcagttcttctccaagccttttgcttttcccataaatggttttcggatcgaggggatcgtcttccctatatggctgggttcctttcccattgaatacatagtccgtgctgatatgaacatattgagcaccgatgcgggttgactcaagcgctgtataataagcgccgattccgttaatcaagtacgctttatcaagctctttctcgcattgatcaaccgacgtaaacgcggcgctattgaccacgatatccggctgataatggccaaacgaatgccgtactgagcgctggtcagcaatgttcatcatcttctttgttaacgcaatgacctcatatccggcttgcttcagctggcggcatagttccaagccaagctgtcctccggccccagttaccaatacctttgtcaatcagatcaccttctcatcggtcattgtctgtataccactgaatcgtacgcgcaatgccttcttcaaacgtcacttcctgccgccagcccagttcatttttcagcttagatgcattgatcgcatagcgccggtcatgcccttttcggtcttccacgtgggcgaacaattcctcacagcccagatgcttcaaaatgacactcgccagctctttattcgtgcgttcatttccgccgccgatgttatacacctcgccgtcggttcctttttctaaaatcagtttgattgcgcggcaatgatcctccgcaaacagccagtctcggatctggagtccatcgccatacagcggaacaggcaggccctgcttcgcatgacggataatcgtcggaatcattttttcgctgtgctgataaggtccgtaattgttgctgcatcgtgtaatgatggccggaagcttgtgggttttcacataagacaacacgagcaaatctgagcttgctttgctggctgagtatgggttattaggagaaagcggcgtcgtttctgtaaacgcgggatcatccgcttttaaatctccgtacacctcatctgttgaaatatgaatcagcttcttggcttttcctttcaagaccgcttccgccaatcggtaagtccccatgacatttgtggtgataaacggctccgcttgggaaatgcttctgtccacatgcgattctgctgcgaagtgaatgacgccgtcgtaggtctcgtcaaacgcccggtcgatatcctcctgaacgctgatgtccccttttacaaagcgaaaacggctgttttgctgtaatttttccatttcctccgggtggctggcgtacgtcagtttatctaaaacggtaatgcgcgcttccgtttccctcagcatgagctttgtaaacgtgagcccgatgaagccggccccgcctgtaattaaatatgattttgccatcacttttcgtcctgtcctttccgtaaagcctggtgtacaagctgggaagcgagataaagcgattcgtgagttccggcatctacccaccagcctgataacacatcatacgtaagctggctgttttcgatgtatagattattaacatcggtgatttccagctcgccgcgctttgatggtgatatttgttcaatatacgaaaacacctctgcatcatacatataaatgccggtaacacaaaggttggtcggtggctgttcgggcttttcgatgatggaacgaatccgcttgtttttctcatcaatctcagcaatcccgaaacgttccgggtcatcaacttctttcagaagcacttttgctcctttcccctgctgttcaaagcgttctgtataaggctttaatgaatcttcaaatatattatcacctaataataaaatgaaagactcttttttcgtaaagcgctttgcataagacagcccatccgaaatgcccgatgctgccggctgtacttgataagtgatagtaacgccaagctcttccccgttcccaagcagtttgtaaaattgcggcatatgctccttttggctgatgagtaaaatgtcttttattccggcttcctccagcttcataatcgaccagtatatcatcggatacgggcctacaggaagcaaatgcttgttgacggctttcgttaagggcataaggcgtgagccgtttcctccggctaaaataacacctttcacattaacacttccttacatgcatttttatatctcttgttcatataaatcttgaagaatagctgttacccgtataatgcctttgccatccacgagcggccttcctcccttgtgcaaagaaaggcgaagaggatagctgctcataatgcgtgacatctgatagatgagtgtttcatccggtacaagctcacccaatccaagatcaagagcggcgccttggccagcaaatgtttttgctgttgccgtttgatgctcaacctgagaaagaacaaggcacggcacgccgatgcaaatggcttcatatagagagatgccgccggcgacaatggctgcgtccgcttgtttcatcaaacctgccatatcatttgtctgttcgatcatcttgtactgcggcttcttttcgatccgccttcggactgcctcttgatgcggtgaagcgctccccatcacaaacatcatgtttttgtcttttatgtcggggacttgatcagcggcagccagcactttaaaaataagctgcttcggatcacttcctcctaatgcaacaaggatattgcggcagtctttcttaagtgtgtaatcctctctagcggcctgaaaggcggggtgaagaataagatagtccggaccttcatagatgcgtgtgtttccctgaacgtacaccctgcttctgatgtgaccgtaaattccgttaatgactgcgtcactatattgaatcgatttaccgtttttctcttcaaaaagaacaattttcgcatctgtctccgtctttattttctttaacagctctgcaggcgcgcctagaatatcaaacaaaagcaaatcaagcttcttgctttttatttcccggagaataaattcgtgctgctgcagctccggctttacgatgacacgccaatgctcttcatgaagaaacgcttcagactcctgattcgtataaaacgtaatcaagcatcgctgtttgagcccctccgcaagcctcttcatccggacaacatggcccattcccttttcatagccgccgtctgcgaagatcccaacatgcatggctagtcagcctctcgttcggttgccgcatcggggttccggttcagaagggtgataagctctgaggcggatacatcggggcgctcgcctgctttttgatagagggcctttatcgattcatagtcttcctttgtatcaatggtcagccgatattgaggggcgcgaaaccgttccggcgcctctaaaaactgaacacgataaagagctggatgattccttatatataacgtgacatgctcctgatattgatcctccaaagcctgaatacggctgatgtcaattaacaggttggcgttgaccacttcgccgcaaatccctaatggggcattcaggatatacgtataatccgagccttgatcaaaatgcgcctgaatcattacatcgagcagctcaggatcgacaaacggattatcacctgttaaccggatgatgactgacggtttaacagcttctatgaccttcacaaacctatcgaggacacgttcttcgctcccgcggaaaacacgaaagccttgtttgatacagtgcgcctctaatatgtcgtcagtttctttgtcagacgtggcgatgacaagattatcccgatccttttggtaaaacgcgctttgccggacacggtgaacgagaatatcaagtaaacgattcgatccgagcggccgaagcacttttcccggaagccttgttgaacccattcttgcttgaatgataaagagaatatcattcatgaaacgggctgtccttcagtaaaatgtcatcccagacaatgcctgtgtcggctggaatgtctcttacagcccgaacaccgctggtcagcagttcaaaaaatctcgggtgcagcccctgcggcttttgtccgggccgaagcactgcgatattgtcttcactaaaggcttcacctttttgaatcggagctgttgtaaaaatgcctctgtatgcaaaatttctgatttctccttcgatggaggttgttgttttgtatgaactgccaagcagtttttcagagaccggctttgtgatcccctgtttcagctcagcttccgttttcctgatgccatcgaccatttctttcaattcatccggatttaatgcaaacgagtggtcggcacccggcagatttttatcgatcgtaaaatgcttttctatcagttttgctccgagccgaaccgcggcacacggcgcttctgtcggatgctcgctatgatcggagaagccgatgaccgcctcaggaaaagcggcggcaagcatcggaatgacgctgaggttgctgtactccggcggtgctgggtatttcgccacacaatgcattatggcaatttgattgtttccctctgccctgatggtgcgccaagcttcgtggacatcagagatttcagctccggctgtcgagaaaatcatcggcctgttcagtcgggcgacatatttgagcagcgggagatggttaatttcataggatgcgattttaaaagcgctcggcgaggtagactgaagcagatcagctgacccctcatcacataccgtacttaaaaagatcacctgcttttcgcggcagtaatccaatagcggtaaaatccactcagcaggcatttccatagattgaaccaaagaaaaaatagagacgtccttgcccgctgccgtcttgtacaaaccaggatctttctggtacatcctatcagcttggaacatttgaaatttcacggcatccgctcccgcttccgccgcggcgtctatcagcgcaaaagcctgatcaagcttcccgtcatgattaatccccgcctcagcaataataaaaacaggagcgtctttgcctacagttttattcgcgatctgaaacgctgccattatttcgcctccttgcccggccaaatatgataatagtaatacgattgttcagcggtgaagcccattcgttcataaaggcggatcgcccttacattgtgaagctgcgtccccgctgttaccgttctatgcttctgggtctccggttgttctacgagattcgccaataaatgaaatgcaatacgttttccttcaaatcccggctttacagccatcaaatcgagaatgcactcatcatctcttgataagccctgaagatagccgatgacctcgccattgtgtttagcgacaatattgaccgccgcccttccattcagattgtttcgtgtccactcctgaaatattttgtttgctgcatcgcggctgagatgaggatcctgaaaatatctgctttttgtaaacgagtctcgggccagctcacatatcgcttctgtgtccccgggctcaggcgggcccagttcaaaaaatggcggtgttttgtcataaaaagacggaggcatcgccagcttcagcaaactcccgacaaagtaagaggatggctgctgctgtatcacatgcgcggctccgatatcttcagccggaacgcggacaaagataaaatccgtttcatccatttggcgtacagtataaaaagcttcaaacagcctctttagctgcccggtactatttgccgcaagaagtttgacgttcatgactttcttctgaagcaccttgctttcccacaaagaatcttcgtaaagcaatacgccttggagcctgctgttttcaaaaaggccgagggaaaattgatacggaacatccagtgtaagctgtcggctttggagaaattcctcaatcaactctttggagacattttcttttaccgtatacacttaatcagccccttttacgatatcccgcacagcttcaatgacatcatctacatcgtcgtcagacattgacggatagagcgggagagaaagggttcgtttatagtaattcatggcattcggaaagtccgcttccttatatccaaattgcttttgataatatggatgaatgtgtactggaataaaatgaacgctagtgccgatattatattcatcctttaaagccgtaatcatttcgctgcgcgtaaccccggcctttttgtcatcaacttgcagaacatatagatgccaggcgtgcctgccgtcatcatggacaaacggcgtgatcagcccaggaatctgctgaaaagcggtttgatagcggccggcaatctcttctctccgtttctgcatatcatccagccgtttcagctgatgaagtccgagggccgcctgcaaatcaaacatattcatcttatagccgggcgattcgacttcatagtaccagctgccatttgaagaataacggttccatgcggctttactcatgccgtgaaggcttagcacccggatcttatcggcaagctcctcatcatcagtcgtcagcatgccgccttcccctgtcgcgaggtttttggtggcgtaaaagctgaatgccgttgcatccccgatagaaccgatcattctttgcttataagtcgtatataccgcatgtgccgcatcctccagcacgaataaaccatgattttgggcaatagccaatattgcatccatatcgcaggactgcccgccaaagtggacgggcacaactgctttcgttcgcggtgtgacggccgcctcaagctttaccgggtcaatattgagcgtgttttggtcaatatccgcaaacacaggcgtcgctcctgtatgaataatcgtattggcggtcgagctgaacgtaagcggagtggtaatgacctcgtccccgggcccgatcccttttgctttcaaagccaaaaataaagctgcggtacatgaatttactgccacggcgtgcttcgccccgacaaacgcggcaaactctttttcaaactgctgaaccttcgggcctttagagagccatcccgattcaagcgtttctgtaacctcctgaatttcttccttaccgattaacggcaatgagtaagggagaaaatgatttctcttttgcaccatttctttgcgctcctatcattttattcagtatcttcccgcctgtaatcaactcctgttttggctttcagttccgcaaataaagcatttgttgattctgccaccggataattagccgctatgaatgccaggcgcgcctcttctgctttttgatgcacgtcgggacttcgaagaacttcaaccaaggtgtgcgccagttcatccggctggtcaaacataaaatcgccaagagactcataatacggatacgagcgatttccggacgattttcctatcagcacaggcttttgaaacagcatggcttcaagaccgactgtcgaggtttgcgtcactgcggcatcaacatacggcagcaaatcataaagctccagctcctttttgatgactctgcatgcttgatgttttttcgccgcctcgtgatacagatcaagcttgttttttccgatttcccacgggtggggtttgataatgatttgcagctgcttctgatcagaaagcccctgcagcacaccggaataaaagtcttctgaaaagggctgagtggcaatgagcacaatttttttagtcggctgaaaagcaagttttcgatagaatatggacatatccataggcgttctgttaaaaatctgatcgaagcggggatgtcccgttacgagaatctgctcgggtttacagccttttcgtatgaaccactctgcttcatacgcaccaaaaacagcttgatagcttgtaaaaacaggaatgaaggcttcatctcccatcaatgcgccatgctgaagacaaatgctgacggccccttttctttgacacatgagagcgagcaccctgctataaatgtcttctgccgttccgacaataatagctgaaatcttttcctgctcaaacagcgcatcaactgtatcaatggcctctataaataaaggaatatctttgaaaagccggtcgcgaaacgcttgatcaccaaatgccgggtgatcatcataaggggccagaagcgaacaggctgtttcgagatactgcttcgaatcgcctttttggcatgaatccgcaatctcccgcttgctaattacaggcagatcacaataatgcggcaaactccatctggccaaaacagccgttttttcaggatcaaattgatagtaattttcgtttgaaaaacgcaggtaatcaaagtgcaaaatgactttccctttaacaggttcgtcatttgttttaacgatgttttggattctttcttcaaaaaacggctgaatctgtccctcatcgatatgctgatccaccgatccgaataattccggttcttcttccatcatcaccctcagttcagggctgatgtattgataaaaattactgataagcccaagcggaatccctttgtagcgaagtttgtcaaaaagctccacgtacttccggtacagcacccaataattgcttaaataggccgacaagctctcaccccattccaagcttttttaatgattcacgcagttctcggcaatttcgctgcggaggaaggttcctgacaaattcatttttttctgattcaaacagctgaaagtgaatcgattggtcggtaatataattcaggtccagctcctcatccagtgggtaaaacggataaaaatgattgactctccaaaagaaccgggcatctcctatacggtaaaacgccgggctttcatcccaataggagccaaacttctcctttaccttctcaagcaccgaatacctgtgcatcaccgagcaatgatcaattgcgcacggcgcgttccatgtcacttgagcggcaggcctgacagtttcttttacaatgtcgcgattctcgtttaaatgataggttttggaggctgagtaaatcacagccttttcagaatgggtatcgagctcccgcaccattttcaggaggcggtccggcatatagatgttgtcatccgtcgcataggtgatatattcaccctccgccttctcaatcgcctgattgatcagtgccgcgtatctcgttttttctgttctttccttcactccagatatatcgctttgataaaaacgcactcggttatcattcaaaaaaggacggattacattcagcgtctcttcattggagttgtcatccataataaacaattcaaaatctgaaaacgtttgtgagagtatgctagaaatggactttgccacataatcgcttttgttatagctcgtcataatgactgatactttaggcaaatcctacacctccttcttggaacttcacacctgaaactatcgttatcttatgttgcttatgctcaagttgcgctagggatacaaaccaatatgcgaaaagtttgtgtatgtctctgaaaaacagcggctgcccagagcgaaatctgatcggtccgctgttctttttcagcataatccaagcatcagcctcataaggtgaaagagataaaaatcgcaccagcgactaagatcgttttccatcggaggtgagtcatcgcggagcgttcacctatacatccagaacatgttttgaatggttttcataaaaaggaggaacgatatgaaaccgaaaaaaaatcaatatcagcaaatgcaggcatttgataatatgcaggggtatcagcctcagtttggcgccaacccgtacccgcagcaaggccaaggctcacaaatgcagacaatggggatgcagccaatgatgccaatgcagcagggacagcaaggacaacaaggacagcagggatttggattcccgggccagcagcagggcggcggttttcaaattccatcggggcctacaccgtcaggaccgggccaaagcgttcccggcatgctgcctgttgaggaatcttacatcgagaatattttgcgcctgaatcggggaaaaacggccaccatttatatgacatttgaaaacagcaaggaatggggctcgaagatttttcgcggcgtcatcgaagctgcgggccgggatcacattattatcagcgacccgaaatcaggaacacgctacctgctcctgacaatctacctcgattacattacatttgatgaagaaattgcttatacgtatccatattccatggcgtcctattcgccaagataagaaaaaagccaatcactcatatgatgaggattggcttttttgtttatagatatttgacggctgcgacaacgatcataatccaagaaataataaacgccacaccgccgagcggggtgatcgctccaagaatggagatttgcgtcacacttagaatatataagcttccggaaaacagcacaattcccgcaaacatcagccagccggctgtcgtgacactgcctatgccggataatttatcagccagaaacgcgacaacgaataacccaagggcgtgatacatatgatactgcacgcctgtgtgccaaacctgaagatacttatcaggtattttcccttctaatccgtgagcgccgaatgctccgagtcccacggcaagcagggcgttaatggcccctaatatgataaaaactttcatctatctctcccgccttttcgttaaactcatatcatttatcttatcgcacctgcaccaaaattcaatgtttgttctccgttgacacgagattgtcggattttctcctgcgccaaagctggaactggtcagcagctattgcagcaagcgtccctaatacgagcccgttgcttaatagagaaataaataccggatgcaatccctttaacgcagtttcaggaacaaacatgataccgacccctgtcagcagcgagatgccgatgatagacctcaccctttttgattcttctttctcatatgaatcaaattcggcaaaggccagaccgcccattgcggagaacacaacaaaattcaccgcaaatccaacgggtgacggcaggctcgcaaacgtattcataaaaaacgggatcacgctgatcacgataaccagaatactgccgagcataaacggttttttagaaggcattttggtcgtttcaataaaacctgcggctcccgaaatcggaacaggcgcaatggctcccgtcaaaccgctaagcagatggctgaatgaagcggcaaaaccggcatggcgttcatgatgctttccatcaggctgtttgctgaattttttcacggcgatgtccacgaccttcatgctcgccagcatattcacgatcagcaagatggtaataaaaatagaagtgatgatcaggccgctgttaaataacggggtcccaaaaggaaacagggaaggcagctgaaacagccggtccggcatttcaatcggctttgccgctccggcagccgcaaacagcacccatccgccgaacaaggctaataaaatagaatattgcttaaaaaacatgatgttcgaatttgtcattataaaggcggcagcgatcacaacaagcgccagaccaaatacaagaccgtccaccccgtcctgtcgataaccgattccgagaattccttttataatgggctgactcagctgcatgacaagaagcaataaatagacgcccgttacaaccggagtaaacaattttgcaagtctgtcaatgaccttgaaaacacttaacaaaaagaaacatacagcgcttacaagaagagctccctgcaacccccgcagtgtgtctccatatgtcgcaaacacagttcccgtcagccctgcgtaaatcgtatacactccccaccacaagccggctgggctttcattgatcggcagtctgtggcctttcaaacactgaatgacggcggcaattcccagtacaaaaaaagtgctttgaatcaatcttgcagaatctgagtgatccagatgaaacgactgggcaaccgccaccggaacaacaatcgccgcagcaataataaacgctgtccattgcagcgcgccaagaaccaatttcacgtaagctcaacctctctctttaaaaatcaaataaagactctccgtttccatcctcttcctgcttctctttttcttgctttcgatatttgtttaatcccgcgctccccatcattttttccatcatcagctggtctgtcgatggcggcgcggcgggacttggcgtaacgttcggctgtatgcggggcgcgctcgcgttctccggctgatcaagcacgacatcacacagagaacggacaaccgctacataacgcttcagctcctcatcccgttcagctgtttttgcttttttcagctcctcttccatcttttgaattaatgcagatatatgaatgttcatgaagcaccctccaaaaaaataaatgttgtcttcctgcattttatcaaattcctgctgtaaacgcagatatgagtttgttattttttctgacaaaccttgcgcgattgacaagcagaagagatttttcacataataaatcaccataccttacaaaaaggagaaacggaatgaacagcatcccctctatcatcagcaagcataaagcctattttgcggcgggacatacaagaccgcttgaatcgagactgaacattttgcgaaagctgaaacaagccgtcagaactcatgaagccgatctcatagccgctctctaccaggatctccataaatccgagcaagaagcatactcaacagaaatcggaatcgtcttggaggaaatcagctttgtcatgaaacggctgagaaaatggtccaagccgaaacgagtcaaaacgccgttgactcatctaggctccaaaagcatcatcatccctgagccgtatggaaccgttttggtgattgcgccttggaactatcccttgcagctggcgctttctccgttgattggagccattgcggcggggaacacggtcgttctcaagccatcggaatatacgccggctgtttctgctattctttccaaactcatcagcagcgtttttccaaccgattatgtcgctatggcagaaggcgggcccgacgtcagcacagcattattacagcagccctttgactacattttctttaccggcagcgtagccgtgggaaaagtcgtcatggaggccgccgccaaacaattaattcccgtaaccttggagctcggcggcaaaagcccctgcatcgtccataaagatgctgacattcagcttgccgccaaacgcatcgtcttcgggaaatttacaaatgcgggacaaacctgcatcgcaccggattatttatttgtccacgaggacatcaaaacgaagctcacagaagaaatgaagcgtgcgatcagagaattttacggccctcagccggaacagaattcacagtacggcaaaatcgtcagtgagcgccactatcagcggctgctcagctttctgaatgacggcatcctactcacaggcggacaatctgatcccaatcatcacaaaattgcgccgaccattctcgaacaagtgagggatgactctccagtgatgcaggaggagattttcgggccgattcttccgctctttacataccgcaatatcggggaagtcattgagaaagtccaatcgcgccctaagccgctcgccctgtatctcttcaccacaaacaaagaaattgagcgcgctgttttaggaaatctgtcgtttggcgggggctgtatcaatgatacgttaatgcatgtggcgacgccgtatttgccattcggcggcgtcggggaaagcggcatcggcagctatcacgggtttgacagttttaacacattcacgcacaaaaaaagcgtcgtcaaacaaacgaaccgcttcgacttcgcatttcgttatccttcctccaaaaacgggctgcgaatgattcgaaaaatactcaaataaaaaagcgcagataacctgcgctttttacaaatccttaatacaccaatcaatcggcgcctctcccattttctccaaataggcattcgcccgggaaaacggtctgctcccgaaaaatccgtttctcgccgaaaacgggctgggatgcgtcgattcaatgataaaatgcttggacgtgtcgatccgttcttttttcatttgagcatgccgtccccacaaaataaagataaccggccgctccctttcactcagcacgtcaataattcggtccgtcagtcgctcccagccttttcccttatgggaattcgcctgtccgcgccttactgtcagcacagtattcagcaaaagaacgccttgctttgcccagctcacaagcgacccgtgattcgggatgctgcacccgatgtcctgctgcagctcaagaaaaatattttttaacgaaggcggctgctttacaccgggcttgacagagaagcttaaaccttgagcctgtcccggcccgtgatacggatcttggccgagaatgacgaccttgacatcatcgtatgaggtataatgcagcgcattgaaaatatcccggctgtccggataaatcgtttgctccgcgtattcccgcttcagcatttctctgagctcttgataatacggtttctcaaactcttcctttagctgattccaccagctgtcttgtaaaagctgtttcaagattcaggcccccttacgaacgatgaagtctggaatagacaggctcgccatcccaaaccatttcactttttgcttcccgcctcttcatctcaggctcttcaagcaggacggcaaagtttttcgtcggcagctccccgagtccgtgcttttcacttaaacgatccaaatattgcttccgcttggcgccaaggtccgcagactgattgtctcccgcgtcactgaaggcataaatcacactggcgcaagggacacgcttcacccggtaatccttggctgcgcgcagataaaaatcccaatcccagtaattgtgcacatcagcatcgaaatacccgatttcatcatgcagaaaacgtctgtacatgctgcccgacggcacgtatgtagaaaacactctcatatcctcatagtcagcggtataagcaaacaatttccgtgacactggatatcttgttccgtttttctcttcaaacgaaactatttccgcatcagaatgaacaaagtctgccgtttctatttcctttgccattttctcgacatgccctggcgtaaagaaatcatcgtcatcacacagcataatgcaatcgccagacgcctcttttacaccggcatttctcgcagccacatgccccgagttcttttctaaattgatgacagcaatcggcagctccggatacagtgctttgaccggcacgaccgattccccggcatcattcacaataataatttcatacggcttcaaggtctggcgggaaatcgactccagaagctcacacaaagccggaatccgattataggtcacaattacgatagaaatcttcatgatgctctccttctcattttcatagtcatgtactattaaaacatatattggacgggagatcagtgggaatatcctactgaaccggataaggtgataatgaaaatactagatgaattgctaagccttctatattgtgatacagagaaaatctaactataatgaaagacaaaacacgatggaggttcaagacatgtctatgcacaaagcactcaccattgccggctcagattccagcggcggtgctgggattcaagctgatttaaaaacatttcaagaaaaaaacgtatacgggatgaccgccttaacggtgatcgttgcgatggacccaaacaacagctgggaccatcaggtattcccgatcgatactgatacaatccgcgcccagcttgcaacaattacggacggcatcggcgtggacgccatgaaaacaggaatgctgccaaccgttgatattatcgagcttgcggcaaaaacgatcaaagaaaaacaattaaaaaatgtggtaattgacccggttatggtttgcaaaggtgctaatgaagtcctttatccggagcacgcccaagccctgcgtgagcaattggctccgctagccactgtcattacgccaaacttgtttgaagccagccagctcagcggcatggatgaactaaaaacagttgacgatatgatcgaagccgcgaaaaaaattcacgcactcggcgctcaatatgtcgtcattacaggcggaggcaaactcaaacacgagaaagccgttgatgttctctatgacggagaaacagcggaagtccttgaaagcgaaatgatcgatactccttatacacatggcgcaggctgtacattctcagcagccgtgacagcggagcttgccaaaggtgcggaagtcaaagaagccatttacgcagcgaaagaattcatcacagcggccattaaagaatccttcccgctaaaccaatatgttggtcctacgaagcattctgcactgcgcctgaatcaacaatcataaacaaaaggggctgccttacagagaggcagccctttttaaatcaccgaagacttttcacagaaaaaactgccgatcccatcggcagcctgtttatttgatttttaaattgtttgcagatttcctcaaaaatgtttctatcgactgaacaaaaagtgcatattccttcatttgttcatatgcccgcgtgagaatttccgccgtttcactgtgcggcgttgttccgccaagcatttttttcagctgaagcagcacatccttatattcttcccgcttatcttcaacttggttagcagccttttccaaacattccggtgttatcttctgttcatgtatattcaagaaaacaactccttttacagaaaaaaatagtaggttatcgttgaagaatagcacagatggctcagatttcacataagaaaatagaaggattttctacataagtgtccaaattccgacattcatttcagatttcccggtcgaactggctgttacttcatgatttcccgggaaaggaaaatatctcgcactaaagacctcttctccgttattgataaagatttccacagatgacgcgtcgagaaacatgtgtacggtatgcaaatccttgatgtggcaatgtctcgcttctgttctttttccgtcaaagctctttcgttccagagtaacaatcccctcgtctttttggaaggaaaacgtagccgttccgcggatactgattgaaaagccagactccgtatgaatgtcttccagcagaatctcagctctttcaggtttttccactggaagcgtaccagatgatccatgcatattgatgtgtatttttttctcatttctgcgcatggcttttagctcaggcagcggctgctgaatcagcttctggcctgaaagcgtcagctgtctcggcagcgtcatgcagtgaatccagtggcagtcaatggtcggatgggacccttcatcctgatcaggcacagccatccatgcaaacaaaatccgccttccctgatcgtcttcaagtgtttgcggcgcgtaaaaatcaaaaccttgatcaagctccataaattcaccatgcttcagttcaggcttgttataatcaagccggccgacaaaataacctgattgatatacgttctgataacggaaaccgtcagcctcaagcccttgaggcgaaacaatcagcacgtccgatccttgaagggaaaacaaatccggacattcccacatgtatccaaaatcgtccagcccgttgaagcccgcgccggttatcgggccaagaaatctccactctgtcaggttatcagaagcaaacaatacagcctgccctttcaaattctctgtttgcgcaccaatcaccatataccatgtgccttcatgctcccataccttcggatcgcgaaaatgcgccgtatatccttccggaaggcgggcgacgacaccctttttctcaaaggacagtccgtcgtcagatacagcaaggcattgatacgtttcccggtttccattctgatccctgacatttcctgtgtaaaacagatagagccgatcgtctttcgtgacagtgctgcccgagtagcagccgtttttatcaaaccaatcactcggagccagcgcaatctcttcccgcttccaattcacaacatcctgtgtcgtataatgcccccaaaattttgcgccgtgccccgtctgaaacggctgccactgaaagaatacatgatagctgcccttccaataaatcacgccatttgggtcattcagcagcccaaccggcggcatgatatgaaaatgctggcggtgcggatcgctgttagcgatgggctcttttttctccacttcttcataagcccggcgacgaagctcctgatcatgtgctgtcattttttcctctcctcatcctcattaatcttcatgacaaatgctgcaatgaacgctgacactgccgcaatcgccatgccaatcagatagtgaatcaagttgctgaagccaaacggagccgcaatggcgatcatcggaatacccgttaacccgtaagcgtttgcagctacatgtgtaaagacgacatatgccccacccaatgcgcctccgatcatcgcggcgataaacggttttcggtagcgaagattgactccgaatatgacgggctcagtaatgccgagaaaagcggaaaatgctgccggaagcgcgatttcttttgtctttgcctttttcgccataaagaagacggcaagacctgccccgccctgtgcgacattcgccattgaccagatcggcagcaagtagttcttgcctatatctgcaataagcccagcctcaatcgcatggaagctatgatgaacgcctgtcagcacgatgagtgaatacgtgcccccgaaaatcagacctgcgacaaaaccggcatggtcatacacataagttaaagcaaccgtaatgccggagccaagcgctctgcctagagggccaatcgcgataaaagcaacaaacccggtgacaatcacagtaacaaatggtgtaacaagcaaatccaccgcatgtggaaccacttttctcgtccatttctctaccttgctcatcacatacaccgcaagcaggacagggataacagttccctggtagccgagaagcgcgatatcaaatccgaaaagatgcatgtaatcaggtgtcgcttccgccaatccccatggatttaaaagattcggatgaatcatgattcccccgatgaccgctcccaagtatggattgctgccaaactcttttgaagcgctgaccccgattaaaatcggcaagaaaatgaatgctgcacttgaaaacatatcaagcagctgcaaaagcgcagaatccttgctcatccaatgaaacgcattgatcatacccagcaatcccattaataggccgctggctacaatagccgggatgattggaacaaaaatattagaaagcgttttcgcaaatctcgcagcgggattcagcttttcttttgccgcatcctgatgatttacgtgttcttcacgctcgatatcagcttctttagaaaaggcatcgaatactttattcacaaggcctgttccgaaaatgatctggtactggccagagctgctgaaagcccctttgacgccatcaagctcttctacttgtgcttgatctatctttgattcatctttcatcactaaacgcagtcttgttgcacaatgagccgcgctgataatattttctttccctccgagaagctcaatgaggcgttttgcagtctctttgtaatccatctatttctcccccttttatttaaacaaaaaagacctaaaattcgccaacgaataaaggacacagcgatcctttttcatttacgcaaattttaggtcttgcctgctttaccagtcacaatcccgcttattcagattaagaatacgctttcatcataaatcatgacagcgttttcgtcaactatttttttagttaaatagtttgataaaacatgtagacaaaaattcgtaaaaattaattgtgaaatacttcacaatatcgtgctatactatgctcaatcatgaaagaaagcaggaaaagacaatggaaactcaagctttgcaaaaggttgaacagtatgctttgaaaaaacaaaacatattcgcttcaagcaaaatccgttatgtgcttcggtccattttggccagtatgtttattggttttggcattacagccgcaagcaaaacaggcagctatttctttatggctgattctccgtttgcctttccggcagccgctgtcactttcggggccgctattctgctgattgcttacggaggcggagatttatttaccggcaacaccttttatttcacctataccgcgctccggaaaaaactcagctggcgcaacaccctgtacttgtggatgtcaagctatgccggcaatttaatcggcgccattctatttgccatcctgatcagcgcgacgggactttttgaggagccttctgttcattcctttttgattcatttggcagagcacaaaatggagccgccggcttccgaattgtttttcagaggaatgctgtgcaattggcttgtgtgcctcgcctttttcattccaatgtctctcaaaggggaaggagcaaagctttttaccatgatgctattcgttttctgcttctttatttccggctttgaacacagcattgccaatatgtgcacattcgccatctcgcttttgatcgagcaccctgatacagtgacactgatgggagcagtcagaaacttaatccccgttacgctcggcaatctgaccgcgggaatagttatgatgggctggatgtactacacactgaatcctgatcaataaaaaaacttccagagatcactccctgcaagtcaaagcggttattccgagagatcttgaagacgctggacatgcagcgtgatatagccggcctcggattccggcaaatgtaattgatattcatttttcaaaaactccgccagctccagcgcacattgataggcgaatgaatactttttttggatgaaataaagcatctcctcgtccatacgatggagcgcttcatttgattccaaccggctgaccgcgtatcgcaaatgcgtgacaaggcgttgataggaaatgctgttttcatccacctttcgattaaagtattgttctattttctctatcatttctttgatcatggtcgtatgcttcagcgccgaatacatgctctccgcatccatcttcgccgtatggatgtgaagggcaatataacccgcttcatcttcaggcagagacacgcccaatgtctcttttacatgtccgatcgcccacaggccgatctcatattcttttttatagagcgcctttatctcatgcagcaatttattctggacaagcagcccattttgaaccctttcgatcgcaaaggataaatggtcagaaagcgcgatatgaatgtggtcgctcagcggcgccgcgagctccccctccgcatagctgatgatatcctcagctatttctatatgttcctccggcagtgtttgcaggatttgtttgaatttttcattctcgtcgcgcacgacaaagattttttccactttattcatagggatgagatcatttttctttttttgaaaagcgattcccggccccatcacgattttttcctgatcatcctcttttattaaagccgcattgttgtttaatactttatagattttcaagaggttatctctcccgccaatttgcttttgactgggattttacctccttttgaccgccatgtaaagatgcgggcccgctctctcctgctttggcgattccttgaaggcttgcaaacatcttcttttataaagcgcggcggctttcgctttctgcttttcttcctcattcacagccatccgccactcataaaacgaaacgagtcctgcggcctgcacagccgcctttctttggtatgtacgctgagccgaatagaccgcggcagccgcagtttttctgtccggcgtcacccagttcatcaaaaagaccatccacacccgtaaagatacaagcaaacgtttcatagaaaaacatccctccgcttctttttggcaggcagcctttttagcagcccgttttctcagccgcagcccgcaagaaaagacggccgatttcttttctcgcaaactagcggctctagcaaaactcatgactctatgatagaccgtggaaagagaattctttgtcacaatatgagtgaaaaaaccaactagtttttagaagttttgttgaaagctgaaagaattgaaatgaaaattggagaaccgctttgaaaactttatacacaagttatcccaaagataagaacaacttaatcacaagagatatccacatgtccacaaactctatctatattttgtatacgaacgtatattcctaactatatatatacacaggtttattcacttatacacagggttctgtgtataactccttcgttatacacaaacaaaatccaataaatggttcaaatgacacaaggatttttttgaattttcaagaaatatatactagatctttcacattttttctaaacacaaagggggaaacacattgaaaaaggggatcattcgctttctgcttgtaagttttgtcttattttttgcgttatccacaggtattacgggcgtccaggcagctccagcttcttcaaaaacgtcggctgatctggaaaaagccgaggtattcggtgatatcgacatgacgacaagcaaaaaaacaaccgttatagtggaattaaaagaaaaatccttggcagaagcgaaggaagcgggagaaagccaatcgaaaagcaagctgaaaaccgctcgcacaaaagcaaaaaacaaagcaatcaaagcggtgaaaaacggaaaagtaaaccgggaatatgagcaggtattctcaggcttctctatgaagcttccagctaatgagattccaaaacttctcgcggtaaaagacgttaaggcagtgtacccgaacgtcacatataaaacagacaatatgaaggataaagacgtcacaatctccgaagacgccgtatctccgcaaatggatgacagtgcgccttatatcggagcaaacgatgcatgggatttaggctacacaggaaaaggcatcaaggtggcgattattgacactggggttgaatacaatcacccagatctgaagaaaaactttggacaatataaaggatacgattttgtggacaatgattacgatccaaaagaaacaccaacaggcgatccgaggggcggagcgactgaccacggcacacacgtagccggaactgtggctgcaaacggaacaattaaaggcgtagcgcctgatgccacacttcttgcttatcgtgtgttaggacctggcggaagcggcacaacggaaaacgtcatcgccggtgtggaacgtgcagtgcaggacggagcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcactttcggctcctactcttcagcaaaagtgatgggctacaacaaagaggacgacgtcaaagcgctcaataacaaagaaattgagcttgtcgaagcaggaatcggcgaagaaaaggattttaaagggaaagacctgacaggcaaagtcgccgttgtcaaacgaggcagcattgcatttgtggataaagcggataacgctaaaaaagccggtgcaatcggcatggttgtgtataacaacctctctggagaaattgaagccaatgtgccaggcatgtctgtcccaacgattaagctttcattagaagacggcgaaaaactcgtcagtgccctgaaagctggtgagacaaaaacaacattcaagttgacggtctcaaaagcgctcggtgaacaagtggctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaagccaaagtggagcgttgaacagattaaagccgccatcatgaataccgctgtcactttaaaggatagcgatggggaagtatatccgcataacgctcaaggcgcaggcagcgcaagaatcatgaacgcaatcaaagcagattcgctcgtctcacctggaagctattcatacggcacgttcttgaaggaaaacggaaacgaaacgaaaaaagaaacgtttacgattgaaaatcaatcttccattagaaaatcatacacactggaatactcatttaatggcagcggcatctccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacggtcgctaaggtacctacattgctgattgtgaaagagcccgattatccgagagtcacatctgtctctgtcagcgaagggtctgtacaaggcacctatcaaattgaaacctaccttcctgcgggagcggaagagctggcgttcctcgtctatgacagcaaccttgatttcgcaggccaagccggcatttataaaaatcaagataaaggttatcagtactttgactgggacggcacgattaatggcggaaccaaacttccggccggagagtattacttgctcgcatatgccgcgaacaaaggcaagtcaagccaggttttgaccgaagaacctttcactgttgaataagaaaaagccctgccgattcggcagggctttttaaagatcagtcagcaaacgcctcctgcaataagcgatacgatcggagcttatcttcaaaatgatgcgtgatggtcaccaccatgatttcctctgtttcatacgctttactcaaagctagcagccgctccttaacctgttctttcgtaccaacaatcattcgatttcgattatcagcaattcgtctctgttcataagaagaatacgtatttttccgaacagcttcatacgaaggaactccctctaaaggaataccctgctctcccgccaaaagtgtaaaatcaagcacagccccaagctcctctgccttcttctccgtgtcagcacaaagaacaaaaacagcaactgccgctcgaggcgtatctcctaacacagacggtttgaatcgcctcttatactgtctgacagtaccctctccgccctctccattgataaaatgggcaaacatatagccagcgccagattcagctgcgagcagcgcgctttctccagatgagccgagcagccacacatccggagccgttgaaatatgcggcgcagccgtcagattcggaaaacggtgtttatcatccgccaaatcatgcaaatacatggtcaactccttgatttgctgcggatactgatcagcattgcgcttaccgccgtcattcagcgcccatgatgcaatcggcattccccccggtgctctgccaagccccaggtcaattcttcctggtgtcagcccctccagaacacgaaagttttcagctactttataagcactgtaatgcggcagcatgactcctcctgatccaacacggattcgctttgttttcgctgctatatgactgattagcacctcaggactggaccctgccagacgttttgaaaagtgatgctcagaaacccaaaatctcttatatccaaggtcctcagcagcttgggcaagcgcaacggtttgctgtaaggccgtttctgcattgctgccctctgatactggagattgatctaatatacttaatgaaaccatccctaccacctcatcctcatcgtatcactgatcttctattttttctccaaagccgctcacactgcttatcagtgttccctatcattcgccatttatttgtgaaagcctgtccctatttgtcggaatatgttacacgtgaaacataaaaacctctccagacggagaggtttgctttagtttttattaaagcccttttctttcacgtagtcatttaaatacgtacgcggcttttgcttcataaagttcagtatttgatcggaccacgtttcttcccgctgcccgtttgttctttctctatagtaatcagaaatggttttgtcatacgtattcatagtatgacggaaatcgtctgtgttcacattatacgtattctcatgataaacggcctgctttggcaatctcggttttttgccggaaaggttcgcaggatggcctactgccagtccgaaaagcgggagcacatggtcaggcgtttgcagcacctctgtcaccttgtccagttcattccgaatgccgccgatatagcaaatgccaagccccatggactcagcggcaatgctcatattttgcgctgccagcgccgcatcaatcaagctaaccataaacatttctgtattctcgagcagctcagaaatatgttcacctttttcctcagccagttgttgatggcggtacaaatccgcacaaaatacaaaaaagtgtccgttcttctcaacgtaaggctgattcccagcaagcacggacagctcacgttttttctcaggatcagaaaccccgataatcgaatatgcctgcacatagctggatgtagacgcagcctgcgcacttttcactaatgtatcaatttcttcagctgtcaaaagctgatcagtaaaagaccggattgaccgatgattcaaaatggtttcgattgtgttattcatcacaagaacctccttatcactttttatcatatccgaaaaaaagtaatctcaaaagtgaaatgctctgcacaaaaaaaagacagcctctgtaaaggctgtctgcatattaagaattaaaaagataacttctgtatttcgtcagttgcacacttgcattatatacaatcccaaatccgattaacgtggaaagtgtcgaacttcccccatagctgacaaacagcaacggaatcccggtaacaggcataattccaatgttcattccgatattctggaatgtgtggatcacaattaacgccgtatagccaacgcaaaagaaagaagcgaaacggttaaacggatgtattttgtctatcagaacaacaagcctgtagattaaaaagaagaacatgatgacaacaatcgcacagcctataaagccaaatgactcacctattatagaaaagataaagtcagtcgtactctctggaacataaaccttcaaattagaaataccattacctaaaataccaccagatcctattgccatgatggcctggtcaacttgccagctgtcatttgaatcttcctgtgtctcatttgaagcagacacccaagaagtgacccgcttaatttgataatcctgtattccaactgatttagcaacgtcaggaaagtttatcattactaataaaattaatgaaatgagtaagatacctgaaccagctatgatcgcaatcaatttccaatttatacctgacataaaaaccattacaagaacgataaacatacatattcccgcagtcccagcatcctgcatcaggataagacctacaggaataactgcgacacccgcaatctttaataacaagtggatatcatccctaagcgtccgaactcctttaggattagcttttccaataactgaagcaagcatcataatcaaaccaaccttcataaactctgacggctgtattgttattctaccgatcctaaaccaactttttgcccctttaataacaggtgcaatagactcgggactgattttaagaataatcaaagataaaataccaatgataaaaatatataaacttaacttttcaagctgttctaaatcaaagtacaaaagaactgtaatggcaacagcccccaaaaaataaaacacaatttgctgaatccaatccgtgttcccatactgcccaaactgaccggcagcataaattgatactacgcttataataaaaaacacaccaaatataaaaatcaaatccccctggtaaaaggggctttgttgtttcttatatcgactcattctatcccgccttacattttcatcggaaaatcactaatgtttattatacatgaaccacgttcaagatgacacgtgaagctcgcttccttttatgttttttcagcatttgcggcgctttttcagctacacgaaatatgacgtatcataaaccgaaatgtttcgattgacacaaaacttttcaaatgaaaaaaacgccataccaaaagaatttgttaaaaaacgaatgcgataatgtgttatgttcccaaataatgtgatacctcatatagaaacagctaaaaattcagagccccatgcccatacattctcctagcatattgaacgaaaaaaataagacgatagatccagtccatttctgcaaaaacacgtatcaatttctggaaaacatggtataataattgtaacagaatgttcaaaaaacaatcacaaaacagacacaactcagttcctctatttcatttttgtaaacgttatcacaaaatgaaaggagacgggtatgatggacatgttttttgcttacttattggttgccagcgcaacgcctctctttatttggcttgataacaaaaaagtcgcactctcagctattccgccaatcatcttaatgtgggtattcttcttcttttacgcaacagaaagcctttctccactaggacacactctcatgattatcttgtttgccgtcaacgtcattgtcgctcatatcgccgcatttatcatttacggccttccgtatcttcgcagaaagcgaagcagctgaagacagcaaaaaaccctcttccaatgaagagggtttttgtattattcgttatggcctgaatgctctgagtgttcagcgcctccaggaggatttccgtccatatggtcaccatggtgatagtgagccgcgaaaatccagatggatccaagtacgataacgatcgcgccaaagaatccgaacagcgtgtttccaacttggattgtgccgttttcgctctctgtcatatgcatgaacatgagaagctgcagcgccgcctgaatgaaggcgaaaccgaagataatccaaagttttgctgatgagctcaggtcagtgtacaccgctacccatagagccagcagggtcaaaacgatagacagtgcaaaacctacaatgtgtttccaaggaaagtgactgtgttcagcagatttgtttgccattttacagaccccccaatcccatgagatagacacctgtaaagatgaaaatccatacaacatctaagaagtgccagtacaagcttgagataaagattttagatgaagtttgcggagttaagccgcgtttcttcaactgaatcagaattcctgtgatccagaaaatcccgattgttacgtgagttccgtgagttccaagtaaaacaaagaatccagaccagaacgcacttgtactgagagccgctccttcatgtacatagtgaacaaactcgttgatctcgcatccgacgaagccggcaccgagaagaagagtgataattgtccaaatgactacgccttttaaacttccgcggcgcatttcatgaacagcgatcccgcaggtaaagctgctgatcagcagcaagaacgtcataatcattaccagattgacttcaaatagttcgtctggcaagacacctccagctgttctgtttttaagaacgaagaaggttgcaaatagtgttgagaacaacacaatttctgcccctaaaaagatccaaaacccgagaatattaagtctgccggtttcagattgatattccataggcgcgttagaattgccgtgttctgcatgttccataactcacgcctccttattcggaaatctttctttccgtctcttttatttcatcaacactaatgtagtagccgttgtcgtattcgaatgaacgcagaaccatgcagagcaggactccgatcaatccgactacgcccatccagtaccattcaaataccagtccaaagccagcgagaccgaaggcaacagacataaagaacggtctgcctgagttgcttggcatatggattttcttgaatttgctttcagggtataattcagttttttcttctttcatatgcaggaatgcatcttgagatttgacttcaggaagcaccgcaaagttgtaatgcggcggaatcgcagaagaagtcgcccaatcaagcgtacgtcccacaccccatgaatctccgctaatttcacgagtagagtaacggaagctgtagtagatgttatagcaaaggattaagaatcctacacccatcatgaaagctccgacagttgagataaagttcaatgttgtccagccgtcgttcggtccgtatgtgtaaatacggcgaggcatgccttgaagccccaagaaatattgcgggaagaaacaaatattgaacccgatcataaagatccagaagaaccattttccgattctttcgttcagcttgtggccgaacatttttggataccagaaaataaatccggcgaaacaagcaaatacagtacccgcgatcagcacatagtggaagtgagatacaaggaagtacgtattatggtattgataatccgctgctgccatcgcaagcataacccctgtaaccccgccgataacgaagttaggaatgaacgcaagcgcccacagcataggtgttgtaaagctgattcggcctttatacattgtaaagagccagttaaagattttaaccccggttgggattgagattgccattgtcgtaattgagaagaatgagttaacggacgcactgttccccattgtgaagaagtggtgagtccaaactaagaaactcaatacagagatggcgataatagaaccaaccatcgctttgtaaccaaacaattgttttcttgcaaagcttgagatgatttctgagaaaataccaaacgccggaagaataacgatatatacttcaggatgtccccaaatccagaacaagttagcccaaagcatcggcataccgcctgcttccaatgtgaaaaagtgagcgccgaacaaacgatcaaatgataaaagtgctaatgctactgtaagtacagggaacgcaaacacgataataaccattgtgatcagtgttgtccatgtgaacattggcatacgcattaatgtcatgccttttgttctcatttttaagattgttaccataaagttgatccctgtcatcagggtaccgataccggcaatctgaagtccgaggaggtagtagttctcacccggcccagggctcatgtcgttacttgcaagcggcatataactcgtccagcctgcgttcggagaacctccgataacgaaagaaatattgaaaagcatcgcccctacaaagaacgtccagaagctcaggttgttcaagtaagggaacgcaacgtcgcgggcaccgatttgaagaggtacaacaacgttgataagaccgattaagaacggcatcgccatgaagatgatcatgattgtaccgtgagttgtaaaaatttcattatagtggtttgagtctaaaaaactgttattcggaagcgctagctgggcacgcatcatcagaccgtcgacaccgccgcggaataacataattacagcagatataatgtacatgattccgagttttttatggtcaacagtagttatccattcagaccacagccatttccactttttgaagtaagtcagtacaaaaataatggcaatggttgaaagcgcaatggaaacttgtgcgcccagaattaatgggtcaccagttacgaaaaattcgtcccatttgaatttcatgcaggcttcctcctttcctgatcaatatcattcttctgtatcatcagacttcttaaattcgtttttctttacgttttcaaacggatctgttttagagtgcggtgaaacggcttgatagccaaggcgtttgcgcgcctccatcgcgtactcagcgtcttgtccgtgatcaacgtatttcaagtgagtagaagagaacgttaattcgtccacattttcaggaagcatcaattcatcatacttctcttttgtcagcttaggagcctcgttctgagtctttttcacccagctgttaaagtctttttctgtaactgcattcacatcaaactcttggtctgcaaaatgttcacctgtgaagttcgcgttgcggccttcgtaagtacccactttgtcagcctgtaagtattgatccatcagcattcctgccatcgcatatttttgccctccaagctgaggaatccatagcgaagccattgaatctgcagatgagattttgaacaagatcgggcggtcgacaggaatgtttaagtagttgaccgtttcaatatcctgttcagggtagctgaatacccatttccagtctaccgaagtagcataaacaacaagaggctctttgtcttttgttgcttcaggagctttttctaacgaatatatcgtctgtacggttggcacagaaagtgcaatgacgattaaaattgggatcactgtccagactacttctaaaaacgtgttaccgtgaatttctgggttataagatccattatctttgcctttacggtcgcggtattttactaaaataatggtaaatagaacaaagacgaccccgacgataaacagcataaatccgatagataacaggattaaatcactttgctgttcagctacaggtcctttcggatctagtactgaagcattgctgcatccccaaggacgaaaaccacagttaacagcgctaatacaagcaacggttttaatgctctgaacaagaagatcaccatccttcctattgatgtaataaatctgaagtgcatacttcctcaaaatcttttctctactttgttatgctatcaaaaacttcacttattagctttatttttttataaacttcatcccattttcgcttaaatgtcataaaatcgacaaaaattgctccaactttattcacatctatcgcttaagatgaaaagtttctagttatttccgcatataaagtaaagaaagatgatgaagaactaattctgacaaattaaggtttaccacaataaaaaacttaggtcaatcaaaaatttcattttgttaaactttctagataggaattattttttcctcgtctagcatcttttcacacggttaccattttaacgcatcaaatattgaaagaaaaggcgcaatgaagagccaatatgctctgaattgtccgtatttttttatgagagcatccagttgtttatcttatacaaaaaagaggaatgatataagcaaataaataaaaaataggatgtgttgcatgatgagttttcttatttcacttatcgtcgctattattatcggatggcttggaagcctgtttgtaaaaggagatatgcccggaggaattatcgggtctatgatcgcaggtcttataggcgcctggatcggacacgggctgcttggaacatgggggccgcacctagccggatttgccattattccagcggtaatcggcgcagccattgttgtctttctagtaagcctgttaaccagaaaaagaggataaaagcagcagcacccgaagcgtcagcgctttgggtgtttgttttgccataaaaatcgaaaaagcctcaaccctagcggttgaggcttttgactggtttgacgcccaactggtcgataaaccttctgaaggcctgttttccttctgttgtctgtttaaacacaccggcgtgttcaagaatgcgagcgaatacatgtcccagctcttcttttatgactagatctgcattctcttttgttatggttctttttcccatcatccgaatagcccactcactatgttttgccgtgagcggattttgttctaaagctgttttcggatcagcagagcatagcgccgctgccgtttctttcatttcctcctgtaagcggcccggcaatatcgccaatcccatgacctcaatcaggccgatattttcttttttaatatggtgaacttccttatggggatgaaatatccctaatggatgctcctcatccgtccggttgttcctcagtacgatatcgagttcgtacaagcctccctgcgccgcgcaatcggtgtgaccgtattatggggcgtatcgcctgtataggcggcaatggcggctttttcatcggaatacgtctgccacgtgcggaagatatggtcagcagcttcggcgacatgacccggttcgtctccttggagcctgagcacagacatcggccacttcactaagcccagcgacacgccgggataatcttttaattcataaacgtcttccgcttctgcacgtgccattggaaaatcatgcgcgccgccttggaaatgatcatggcttaggatgctgccgccgacaatcggcagatccgcgtttgaaccgataaaataatgcggatactgcccgagaaatgacagcagcctttcaaatgtttttttgctgatctccatcggttcatgttcaccttttaagacaatgcagtgctccggataatagacatatggcgagaattgcaggaaccattgttcgtcctcaagggtgaccggaatgattctgtgattttgccgggctggatgattcacgcttccctcgaacccgacattttctttacacagcaaacacatcggataatttgtctgttcctgctcttttgcagccgcaatcgctttcgggtccttttcaggctttgataggttaatggtcatttccagttcgccatattcggtcggcaccgtccaatgaacatttttggcgattctgtcagtccgtatataatagacatcctctgaatattgatagaattcctttgtcgcctgttttgggccgtataatgcttttgtctcttcaaatttgcgaatgacctctgacggagcaggtacaaaacagcccatcagctttgcgctgagcaggtcacggtacgtatctgtatccgcttccattcggccggtttcggcagcccatttatagatgggagcgagcaagtccggcaggctttgtgactgcttgatgcagatgccggagaccggctcgggatgtgtgatgcccagcgcttcataaagacggtttctcgtatattcccgatcccagatcgaaatcaattttcgttccaggccatactcaagcagctgttccagatgttcaaaaatactcatatgtcactccccctttagttctctcgctccctctccgatatccgcgacataaaaatccgctcggagccctgtttttgcttgatatctgtctccaaccttctgaataaaatcatcaacgaactcatcttttacaatgctgatggtgcatccgccaaagcctgctcccgtcattcttgatccaattacaccttcgtgatcccatgccgcaaacacaagctcatcaagttcagggcatgttacttcatagtcatccttcaatgaaaggtgggattccttcattaactgcccgatttcatctatattgttctctttgaacatatgggccgtcttaatagcacgatgattttcgtatacagcgtgctttgcccggcgtctgttcgtttcattttggatcaggctggaatgcgcatcgaaatcagaaggcttgatgtcgcccagtgcggcaatatcgaggccttttttcaaatcaagcaatgcatcattgcattcttggcgtctcgtattatagcttgagtcagccaatgtcctttttttgttcgtgttcgcgatgaccagcgcgaggcctgagacattgagtttgctatattcatagtcaagcgtgtcgcagttcagcagcatcgcatgatgttttttccccattccaattgcaaattggtccataattccgcaattgacgccgataaaatggttttccgcatgctgcgccattttcacaagctcaagcgcatctacttcaggatgaaaatagctttggagcacgacccccatcagcagttcaatagaagcggaagacgacagccccgccccgtttggaatattccctgaaaatacaatgtcaaagccatggggaacttcatatcccctctgttgaaattcataaataacgccttttgggtagttcgcccagtcgtcttctttttgatagcgaatgtcgtcaaggctgcattccttgatgcctgcgtttctaaagttatctgaatacatccggacaagcccgtcgtttctttctgcaacagcagcatatgtacccattgtcagcgcgcacggaaagacatgcccgccgttatagtctgtatgttctccaatcagattcactcttccaggtgcgaaaaaaaaccgtaacccctctttttctccgaatacacttgcaaatatcccctttagctcttcccgcatgtgcaatcacctttctggtttttattttttattccccttatttcttcatagaaaacggcagatcatatgctgcagtcctctcataccccttcttcttttgtttttttaaagacgagccatttgctcgcaacatagttgacgacaacaatgaccgcgttgtcgagtattttggccaaggtttcatttgtattaaactggccgacaagaatgatcatcatgcctaaatctatgccgagagacaggacccgaacgctgaaaaaagcagtgagctctttcagcaggctctgcagatcatgtgttttttgctgaaacacatataatttatttgttatgtaagcaaacagcacggacaaaatccaagcggcaacagtggcggctttgtaatccacattcatgatctctaccaatatataaaagctggcgatattcacaatggttgtgaaaacccccataatgatatacataattatttctctatacttcactgatgttcctcgctttctgaaaaacttttcaaaattcttggcgtctcgtgctctctgtctaaagtaaaaaataccgagagtgcgtctaaaaagctgcggaaggtggctggctggcccaatacatatgattgtttgatgattccgtcgaggactgcacatattattttagccgtatattcaggatcaatacaggcgtcaatcagctttctctccttcagccacttaatatataacacattttcttccacccacaattcgtacagccggacataggccttgcatttctttaagactttatatgtcggcatgttcatggcaaacgaggtgatgtcccacgacggcttatttatgtaataggaataaagcagttctgcagcgtgttttgcagcctcgtccaatgtcagcgatttcactgactcccgctccatttgatcaagataccctataatgatcttttttttcatctgacgtttttcgagaaggtacagcagaaaatcgtccttgctgacaaaatgaacataaaatgctcctttgctgtacccggcggctctgctgatatcttctacagaaaccggatcatacgctcggtcaatcaacaaattcacgccagcgtctataaaactttcaaatgttgcttctcttttaatttgaaatttgttttttttcatatttttctcctggcggtaatgattacccttatcttacaccggatcaatctttagcggtatttatttctttgaacggttatgctattcggtttcccaggggtcatttttaataggctaaatgatttattttcatttacatactatccagtcagtatttaattgtttattattataaataaggtccattggttatattagtaatttttttagggaataggtaggtggtttttccttcagtttgtgaacaccgagcaactatgtgtgaaatttgttgtactcgcctcatcatcgcgctggcttgtcttttattgcccgcatgttgcaggaaaacattttatacaattggaggttactatgaaaactcatgttaaaaaagatttggacaaaggttggcatatgttaattcaagaagctagatccattggattaggcattcatgatgtgaggcagtttttagaatctgagacagcatcgagaaagaaaaaccacaaaaaaaccgtccggcaagactagtccgaacaggcggatctatttacctctggcttttctatcacctgatctgagttttcaccatatcctctattcaaaagcaaatcgctgcgctgagcttgaggacaaacggtgtgtcagctaactacgacagacagccggtgatgcgatcacctcttggcacatgcattgtcataaagaggtgatgcgaacatgataaccgtgctctggtaaacagcagctttgctgagaacaagctgcattcggtgaggttttgaaagcaaactcgtttatacacggccgagcttgaaaaccttcgcctgtctttagaccactgtgttcacctcttcacgactcccttcttttttcatcctccagatattgttcaacgcataaatcggactttcagtacatacctattggtgtacctttttgcttacgtttagcgaataaaaggaggaaagccatgtacaaagctgattataaacagattgctgcaacgccgtcttttcaagcttttttaaagcagaaacgcgcttttattgttccttctgcgattttcttttttgttttttatttttcactccctgttttgacatcttatttcacctttttgaatgcaccggccattggagctgtttcatgggcttggctgttcgccatcgcccaattcgctatgacctggatactgagtactgtgtattcccggagagccgcccatttcgataagtatgtaagcgctttaaaaaaggatctgaagggtgaacagacatgaatatgactgcttttttattatttttgtcgattgttggcctgacgcttattatcacgtattttgccgcgaagcggacgaaaacgacgagtgagttttatacggcgggcggcgggctcaccggcgttcagaatggactggcaattgccggtgactacatgtctgccgcctcgtttctcgggattgccggaatgattgcgttatatggatttgatggcttcttttacagcatcggttttctggtggcttatctcgttgtcttgtacatcgtggcggagccgcttcggaatcttggaaagtacacgatggcagacatgattgccgctcgctttaaagaaaagaaaatccgcggtgtcgcggctctcaataccattgccatctctactttttatatgatcgcccagctcgtgggagcgggcgcgctgatcaaactgcttctagggctggattataccgcggctgtcctcatcgtcggagtgctgatgaccatttatgtcgtgtttggcggcatgatcgcgacaagctgggttcaaattattaaagccgttttgctgatggccggcacactcgtgatttcgattatcgtgttttcgaaattcggctttagccttaataccatgtttgaacagatgaaaacggctactccgctgggcgctgattttttgaaccccggaaataaatacaaggtgccgcttgagaccttgtcgttaaacttggcactcgtgctgggaaccgccgggcttccgcatatattgatccggttttataccgttaaggatgccaagacggcccgtacatccgttgtgtcagcgacatgggttatcggtgtgttttacattatgacggtatttctcggctttggtgccgcggcatttgtcggttttgacgcgattacggcggctgatcaagcgggaaatatggcggctccgcttttagcaaaagcgctcggaggagactttctgttcgcgtttgtatcagccatcgcctttgccaccattttggctgtcgtgacagggttggtgctgtctgccgcctcagcatttgcccatgatatttacagccagatcatcagaaagggagaagcaactgaaaaagaacaaatgaaagcggccagatgggcttctgtcgccgtgtcagtactctcgattctccttgcgatttttgcacaatccttaaatgtggcgttccttgttgcactcgcgtttgcggtagccgccagcgcaaaccttccgctgattgtgtttacagtcttctggaaacgattcaatgcctcaggcgctttatggggcagcctgacaggcctgatcagcgcgcttgtgctggtgtcgatgagccctagtgtgtgggacccggccggaggtgctatttttaccggtgatccgctcattccgctgtctaatccagggattatttccatcccgcttggcttcctcggcgcgtggctcggaacggtgctgtcgtctgataaaacaattgatgaagatacgtttgcggaaatacaggtgaaggcgcatactggcatccatatggaacaggagtaaaaaagctctctttatcgagagctttttccttgtcttttcttctgttcgtcagaaatcgctttttcaaatacatccttgccggcagcacccggaattacagtgtcaccgataataaaggttggaacggctgtgatgtcagcctcttcataggcgtgcttcaaggcttggcgctgcacgtcctgatatgttcttgtttccagtgctgatttgaatgatgcaccgtctaatcctacttcctcggcgagcttcgtcaagatgtcaatgtcgccgatattttggccctcttggaaaaacgcctgaaagacacgggtgttgtattcatgtcctttattgtatttcttcgcaaaatggaagccttcaaacgcgaggtctgtatacggatggggcgagacgtttggaaaattgatctcgactcctaatttctccgccattggctgaatagatgtctgccacatgtactgtttggaaggatcattgaccggatcaagctgaggagatgggcttgggcgcagttcaaacggcatccactcgacttcaacatcctttccttttatcgcttcttcaaaagcggcttttccaacaaaacaaaatgggcagacgtaatctgaataaactttaatgtgtactgtcatgataatctcctttcgtataaattgattttaaactgtaacaattaaagttacaactgttttttaaataaagaagccgatttaggcttcttttatgattccagcaaacgctgggcaatatattctccttttttgcagccgcctgggcatgcatataaagcagaaccgattgtttgtgtatattcgtttaacgcatcctttgctgaaagagccttcagcatcgggataaactgattgtcgggatttttttgaaaactgataaacagaagacctgcatccatatagccggttttcggatcaagtccttctgtgtaagagaaagctcttcgcaaaatttgttttcccgtagatttcgctagactgacgtgtgaattagacggaatttgattcagcttcacgggatctgtttcctttttctgcccaaaaggcgcccctgagctttttctgcggccgaaggtatcctcttggtccttaagggaagagcggtcccatatctcaaggaacattttgattttccgaaaagccatataggtgccgcccgtcatccagtcaggttcaccggactgaacccacacgatcgagttcatcaagctgtcatcctccgtgctctggttgcctgttccatctttaaacccgaagagattgcgcggtgtttcgccattttttcctccgcttaaaaagcctttgttcacaaagcggacctcacaagtgccgaccgcttgatttagcaggttacgcagcgcgtgaaacgccacttgctcgtcgtctgcacacacttgaatgcagatgtccccgcctccctgcttttcatccaggttgtcattgggcatcgctggaagagcggctaggtgcttcggttttttgcttttcagcccgaagcggtcctttccgtctttttcaaaaaaaccaggcccgaatccaaatgtgaccgttaagttggaaggggataaatcagcagactcacctgtatcctgcggcggcagatactgatttctctgctccgctgacattttcttgccagatgtcagcatctgtgtgagacttgtccagtttctaaataacgtaatgatgtcgcttttgtcttttgctgttacatccagcgcagcaaaatagacatacgtttgatgggcagttgtgattccggcctgatgctttccgtaaaacggaacaatctgctcctcctctttttcatccttttttgatggcttagccgcggtctgcacaagcggagcgagtccgccgagtccgctggcaccaatcgcaacggctgcccccgccattgccccccattttaaaatgtcccgtctgtgaatttgttctggctttttttgttcatcgctcatgctgttacaaaactccttttatagcacattcgcaatcttcgacatggtttcagaaagagtcgtcagctttgtgctcagctctctgatttgcttttcacttaatttatcataagacgtataggactgatcatttgttttgtattttgccattaaaacttcaaattcgctgaactccgtatccagtttttccgtcaagtcggagtgatcttttacaagcgcgcttttcactgtttgataaacggcttcggagccttccacatttgccataaggtccactagatcaattcgtgagtagcgctcttcttctcccgtgattttcgaaattccggcttcgttcagaagctccatcgcgcctgcaacaatttgttcaggtgttaatttcagtgattgaattgaaccgtcaagctcttttacatccttgagaagctggtcagctgttgccttttccccggaaatatcttgatccttccaaatggccttctcaagcttatggaagcctgtccatttgtctccttcttcaacatcgttttctcgagcatcaattttcggatcaagatctccgaggctttcagcgatcggttcgattcgctcgtaataaacacgcgctttcgcatataacgttttagatttttcgatatcgccggatttcacagcactcgtaaatgcttcagtcgctttgacaagctggtcactctgctttttgacatagcctttatactcatccgctgcttttgccagctgatcgctagcctttttgccgctcttcttcgcttctgtcaggtcttctaaggatgctttcaatgactcggattctgtcttgatttttgctgtatccggtttgtctttttgcgcttctgtgtagattggctgaagatgtttttcgatttctgtatattcgaatggatagtcgctgcgaatgtcgttttcaaaggaaagccagtagctgtttaactctttccccttcttttcaatctctttttggtctcctttttccgctgagtcattcagcttggaaatgatggtttccattttatttacggatgcggtgatttctttagtgaccccgcttttttcagatgaagctttttctttggttgaagatgtgtcattggctccgcagcctgcgcacagcgcaaggatgcatccggctgatacagcgatttttgtgaaattcattttgtcagttcctttccgtttgtaaaatgttttgccgcttctgaaacaagcgcaatcagtaaaaagagtaaaatcaacatttgcggaatcgtgctgtacacagacggataaattcccagcaccgatacagacggcagccagctttctgcatcagacggaagaatgcccgccagttgaaggctgtgaacgccggttccgagaaatttcacgcacatatacaggacaaccgccattgatagaagaaaaaacggcttcaatggaatgtgcattccgagcttgatcatcagaacaccgacgatgacgagaacgataagccctgcggcagttccgccgatcagttcagtgagcgggagcttcccgacaagcccgatgaaaaagatgaccgtttcgagaccttctcttacaactgccagaaatgcaatgagcgcaaaggaaagcaggcttcgtttttttagtgcctgtgacttctggatattgattttttctctccatttatccattgaggcgtttctgtgcagccacaccccgacatacaaaagcatgacagcggacagtacgccggtaacgccgccaagcaagaaattgttttctccgaatacactggaggagaacagaaccgtgacaccgatgccggctgctaaggaaacagccatgccggcggacgccccgccccagatccatgccgaggagcgcgtgacccgcgctttttttgtcatggttaatagcgctccgatgacaaggagggcctccatcccttcacgaatcgggatcagcgccgcgtcccaccagctgtagctgcttgaagcgatcggctcgagcaattgaatcatttcgtcaatttgctttgataccttttcaggatggctgccgatctccgccttcatcagcgccagattttcctccgatgtcgtataggcttctttcgattgggaaacgacgtccccctctacggcgagccaggatgtaactaaattgtcgattgcggatgatgcttcatccaattgttttttttctattaactgcttcgtgtctttcaagctgtgtatataggctgttaaggacgcccttgattgacctgaggttgtctttttcagcacgacagcctgctgataggtttctaaatgagacgaaagctcttcaagctgtgttttgagcttatctgcgtctttattgataaaagaaagagaaatcattgcgatattcgcgtccatttcgctgtgagaagaaaggttttcctttttaatagaaggttcttcttttttccacttcgctttgaaggtttcaaacgtttgttgtgccgaatccatatccccgtctgttacggatttgatcatttgcttgtttaattgaattaatgcggcgatcggatcatcttccgcatgtgccgcagaaccgaaaaccatcaacaagctgaatagaataagtgccagcccccgagccatcatgttcctcctataattgaaaatgattatcattgtataacataatcatagccagttcctgtcctttgtcaattaaaatttgaaggtctgaaaaccttgatggacagcaaaaaagctgtccttttacagaacagccttttgaaggaagatgaacgattatcttcctgttttatacgtttgaatttcctcccgaaacttgcgtgcagcactctcatgatctttcgcctgactgatagcgctgatcatactgacgccatcggcccccgcttggataacaggtgcggcattatctattgtgatgccgccgatgccgacaattggaatgctgatgccttggcggcggactgcttcaataagagataccccttgtaccgctctcgtatcttttttcgtttcagtcggatagatcggcccaagcccgacataatccgctccgtcttcttcagcttgcttcacctcagacatcgtatgagcggaaacgccgagaatcatatcacctatggcagctcttacctctttcgcatttgcgtcttcctggccgatgtggataccgtcagctttcagcttcagagccaatttcacatcatcattgacaatgaacggaacaccagcttcacggcaggctgcctgcactttttcagcaaattcaatccgggcctctcctgtcagcgcatccccgcctttttcacggaactggtacagggtggcaccgccttttaacgctttttgtacaactgtaacaggatcggctttcgtattgtttgaccccataatgaagtaaacagataataactctttcatcatttcccgagaaatacgagtcatgagacagtcaccctttctatagtcgcccattcttggacgtcttgttcagtaacagttgaaagcttgttcaacaattcaatctgaaagcttccaggaccttggtcagccgtctgctgtgcggcaagctgagcggcgaccccatacgaggaaatggccgcaatagcagcaaacaatggattttcttccacagcgcaaaacgcaccgacaacggaagtcagcaggcaaccggcgcctgtcacttttgtcagcagcttgtggccgttatgaagggtgtatacgtgtgacttgtcggctatgacatcgacttcaccagttatcgcaatgaccgtgtttagcttttgtgccgcctgctgagccagccggatgatgtcgcctccgccttcacccgcatcaacacctttgatcagccaatcggtcacgccgacggtatgggcaatttccgccgcatttcctctgattgcagctaggcgcacctcacgaatgatgtcacgtgccgattcagtgcggaacggtgttgctccggcaccgacaggatcaagaatgacgggaacgccatgttcattagctgattttcccgcgatgatcatcgcttcgactgactccttgctcagcgttccgatatttaaaacgagtgcacccgcaatcttcgccatatcggcgacctcttctttcgcgtatgccataacgggcgatgcgccgagcgcgagcaggccgtttgctgtgaaatttgttacgacattgttggttatgctatgcaccagtgggctatgccggcggacagccgtaagacatttcgctgctgattgtgcatccatgtttgcatcatcctttactttcttttttcgggtcccataaatacgatttcgtgtgttcgagccaagctctggcggcaaacgacaagtacctgtcctttctccaaataatggcgaggtgccaagggatgaccggatcgacaagcggaatgactttcactttttccgggtcaaggccgcggcagatccgttccggcaaaagcccgatcccaaggttggctgataccatctcactaataaaatcccattgtgatgtttcataaatgatatggggccggaacccagccttgatacattccgtcataattcggttgtgcaggacaaaatcctccctgaagaaaataaaaggctcgtccttcaactcacgcagctgacattctttctcatcagccagccggtgggaagggtgaacgacaagcattaaggtttcttttacgattgtaaacgaatgaaagatatcttcgtttgcaggaaggaccacaacgccgatatcaagagagccgtccccgacaccttcttggacttttatagaaccgtcttcgactagctgaaaggtgacattcggatagttttcacggaaatcgccgagcactctcgggaaaaaccccgatccaatcatcggcggcagtccaatccgtacgtgccctttcttgacttccataatatcatttaattctgacgtcaggttttgaaatgatttaatgatttcctgcgcctgcacatacatgctatggccggcatcagtcagttctacctgcctgccgtttcggtaaaacagttcaattccgagctcttcttctaaatttttgatcatttttgatatcgtcggctgagaaacataaagggattgggaagccttcgtaaaactttttaaacgggcgacttccaagaaatatgttaaatggcggatatccatgtgcttcaccctttctatagacaaaaggaatacttcttattcttaatatatattttacctatagcgagaccttatgtacaataagtatataagggaggcatcaatatgaaaaaactgttgctaaccgttattcaaatcgctctgttatttatatttgctcggctgattaattgggtgacagcccttcttcatataaatattcccggcagtataatagggattgtgattcttttcacattattgcactttaacattatcaagcttgaatggatagagcttggtgcagcgtggcttctcggggagctgcttttattttttatcccgtctgccgtcggagtgattgaatacggagacattatgtcgaaatttggtgtcagcattctgcttgttgtcatcatcagcacgtttgtcgtgatggtgtctacaggaacgcttacacaactcattgcaaagagaaaggagaaaaagcatacgtgttcatcggaattgtaagtttgtttttaacggttttggtgtatttaggagcaaaaaaggtatatcaacgctttccgcgtgtttatacgtcgccgctattggtgacgcccgctgtgttagtcggtctgctgctgctggtgaatgtcccgtacgagtcctataatctcggcggcggattgctgaccgatatgctacagccggccaccgtggcattcgctatcccgctatataaatatttccctgttttaaagaaatacgcagtggaaattattttgaatgtggccgtcggttcatgcatcgcgattatttctaccgctcttattgcgaaatggcttcacctcggcaccggcttaattgacagcctcgtcccgagatcagtgacaacgccgatcgcgatgaacgtatctgaaatgatcggcggaatgcctgccgtcacagccgtgtttgtgattttaaccgctttgctcggcacagtgatcggcccgatggtcatccgttatttccgcattgataacgaaattgcgcggggcgtgctgcttggcacaagcgcgcacggagcgggaacgtcaaaggcatttgagctcagctctgtgtccggcacaatttcaagcgtatcgatgatcttagctgcgattatgacactttgcgcggcgccatttttgctttcatttatgtaaaaaactgtcctctcgagggcagttttttttatgtgcttccccttattgaaaagctgacgaattccaatataatgtatttgtggataccaaaggaggcaccctgatgcacaacttgcaggtgagacggcattatgccgcgttaaaaggattttatttgtttgcttttctcggtacgggcagcatgattcccctactcagtatgtatttaacgaaggaacagcatttaagcggatcacaggtcggcttgatcatgtcactgggcccgattgtgatgattttctttcagccgttttggggcatgctgagcgattatacgcaaaaaacgaaaggcctgctggcggtttgcacatcaatcacaggcatcattggactaggctatattgcatttgacagctttcctctgtttattttgattgcggcctgttttgcagcctttcaaagcacgattattccactttcggacagcatttcactaaggtacacacaagaaacaaacggcaactacggcggaatccgcctgtttggctctctcggcttcggcgtcgcggtgtttgccatgggacaggtgacgaaccagctgtaccccattcacgtgatctttatctttggctgtgcctttctgtgcattgccgccatattggcttctcaaatgccgggccagcagaaaacgaaaacaaaggtcaatatccgcaaaggattccgggagcttatcagcaacaaaaccttcctcatctttatgatcatcacctttacgacatttgctccaaacttagcgaacaatacgtatttcagtctttttctggacaaaagcggcgcatctctctccgctatcggcattttatttttcatcggcgtgatttcagaaataccatttatgagattcgcccaaacatttatagataaaatggggctgctcaacgtcattatgctgtcaggcggagtctcattattcaggtgggcgctctatttcacggcgccttcactatggatcatttatgcgacggtctttcttcagggagtggccatcggtttatttatcccggcggcgcttcaatatgtgaaaaagattaccccaagacacgttgaagcgacggcgctgaccatgtacgccgccattggcaacgggttcggcaactggttctgcacatttgcaggcgggtacatttttgactacgtgtcgattttcgcggtctacttgctttttggcattctgagcatagcaggctttggcctgacattatatttaatgaaggctgaaaaaaacaaacatacacttcatcagccggctgttacttttaaaccataatgactataatgaacaaaagaaaggatgtgcgttatgaacgggcaagagcgaaacagcatttcgaaagggttgcaggttgatattgtattgaaagcagatcaaaaaacaggaaaactgacgagagggacagtgaaggatattttgacgaaatcaaactttcatccgcatggcattaaagtccgtcttgaagatggccgcatcggccgcgtccagcagatcatttctacataaaaaaagctgcccctgaacagggcagctttttcattattttttctgcagaaggaccactttcaggtagttgccttccggaaatgccgaaatcgttttgaaatcctccggcagcgtaaattcctcaatgatggtgtagcgttcgtttgtttctttaaatgcggcatcgataaagcctttgaatttcttcatgccaaaggcgctgctgtttgtagaggcaacaatgacacccttgtcagcagtgatggcgatcgtttccttcagcaggtttttataatccttggccgcgctgaaggtgcgtttttttgtgcgcgcaaaggaaggcggatcgagaataatcagatcaaagcgcaaatccttttttgcagcatatgaaaaatagttaaacacgtccatcactttaatgtcgtgcgcttcgtaatccagcttgttcacgctgaattgctcgatcgttttggccagacttcggtttgccacgtcaacgcttgttgttttctccgctccgccaagcgccgctgccacggagaatgcacccgtataagaaaacgtatttaaaacggttttcccttttgcatagcggtctctgatcgccttgcgcacatgtctctgatccaaaaagatgcccgtcatggcgccttcattcagatccaccgcgtattgaatgccattctcttggatgatgatcgggaactcgccccttctccctttcacgaagtcatcatcttcaacgtattgtccagccgtgtcgaagcgtttcttctcgtaaatcgctttataatcaagatccatctcatccaatgcggaaatcagcatgtctttaaaggtgtaaattcccttgctgtaccattgaatcagcaggtagccgtcataatagtcgatggtgacgccgccgacaccgtcgccctcaccgttgaacaggcggaaagctgttgtatcttgagcctcaaatagtttggcgcgcgcttgggccgcttttgttaatttggtgagaaaaaatgcctggtcaacctgttcatgtttattgcgggtaagcgtccagccgacccctttgttttgcaggccgtaatagccccgcgcgagaaactcgccgctctcagacacgatatcaacgaggtctccttctttcatgtgccccgcactccctgcgagagcttctttttcgataaggggatagccttttttgattttggcagcgtgtgctttctttagggtgagtagcttcatatatgtcgtcctctttctgtttgctttctcttatcgtaccacaaaacgccaagatgtctgcattgacagaaaggaaaggtttttctacgatagacaaaaagagtttcgaggaggagcagcatgccaaaacgaattgaccatacaggcatcatggtaagagatattaacgcgtccatcacattttatgaagaggtactcggcatgaaattgaaggatcgcatcacacacacgaacggtgtaatcgagcttgcatttcttggctttgaagacggcccggaaacagaaattgaactgattcaaggctacagcagcgagcttcccgctgaaggaaaagtgcaccacattgccctgctgactgatgacatcgcggctgaatatacaaaagcggaaaaaatgaacgcaaaatttatcgacgaggagatcacaacacttccaaacggataccgttatttctatatcgaaggccctgacggtgagtggattgagttctttcagcgataaaaataaagaacgtacattttgtgatgtacgttctttttttatctataccaactgatatacgttgactcatcgcaaatcatagcttcccagcccatacgctgaaccaggtcattgatgtttttatcttttgctaagaagacattaatgaatgagtcatatacactcataaacacaaagtccattttctcatcagtcaaaacgagctctgctgcggcttcatcaagaaccgtccgcaagttggcctcagttatgtccaaaacgccacggttttccacaatcggttctgcgtaataaaaccgattggatccgttcgcacctaacacctttaccgaactcggaatatgaaaatttgaaatatgatcctcactgggataatagaggtctccatttatgttttcatgtaacacctcagccaaatcctctctcgcgcactcgtcccttaaagcgcctctcgacgtcattaaagccagcgccagctcagcatgtgtttgaaagccgcaagaagacataaccttcttccaggaaacagccttgcctattcctcttatttcatcatcgtttggataaatatgctcgtaatcatgttttctttttgcattctcccatccttcaggcatttggataaaaggagaaaaaataagagcagctgatgagtattcaacaggtatttgttgtaagatcggtgattcgtgattgaaccatatataatctaacatgcgcacctcctttacaaattctaacattcctttcgtttgaaagagatgatcagccccatgacaggctgatcacctatcacatcacatttttatctccggattcaaccacactctcttcccgccatttttgatgatcccatattctgaaaaacggatagtagatggcacaggtgatcagcagattcaccagctgcataacggcgcccgacacctttccgcctgtcgccaggtaacctgatatgagcggcggcatcgtccatggcaccgcgattccggccggtcttgccaccagcccggtgctcatgccgatataagtcgcggtaatcgtgaggagcggtgcaatgataaatgggacaataaggagcggattcatgacaatcggcatgccgaaaatgatcggctcgttgatattaaaaagcgcgggcccaaagctgcttcatttgtttgctgcgagatcggacaagcatcgtcaggacaagcgccagtgtcgctccgctcccgccgacattgatccaaatttgaaaaaactgagtcgtaaaaatactcggcagcgcctcgcccgcttggaaggcaagacggttggcatccatcgcgccgtaccaaatcggcgacatgattccgccaatgatggaagccccgtgaatcccgcacgaccaaagcagcatctgtacaaattcagcaatcaggcttccgccgagactgccgccaaggatggaaagcggtgtgccaagcaggtctcctacgacattgtgcagactctgaaaaggtgtcatttcaatcagaagacgcgccagccacacgagaaacacaatgataaagccgggaatcagcgcgacaaacgatttgcttaccgcaggcggcacaccgtctggcattttgaagacgatatttttttgaataatgtaccgatagatttcggttgaaaacaaggcgatcagcatggcgacaaataagcccttgctgccaagtagcgtgatcgggattccgccccctaccatgatggactccgttgagccatccggtgtaaacggcacctcaaacggcgttgccaatagaaatgcggcaattgaaatcgctccggccgaaagggcatcaacaccatagctttccgccagccgataggcgatcccgaaagcggcgatcatcgccataatatcaaacgaagcattgacgggatatccgagcttatcagcccactccttcccaaacacactcgccatgaaatcagcataccccggaatcggcaggctcgttaaaatcaagaagacagacccgataataatcagcggcatggtcaggataattccgtcacgcaaagcgctgaggtgccgctgtccggcaattttcccggcgacaggcattattttttcttccattacccgagtgaatgcgctcatcttaaaagcccccttttctcattgctttgtgaacaacctccgcaatgttttctttatcttattttgaaaacgcttacaaattcatttggaaaatttcctcttcctgcggaaaaaatctgcattttgtcaaacagtcctgtctatgaaaaattttttccttctaactattaatctctcttttttctccgatatatatatcaaacatcatagaaaaaggagatgaatcatgaaaaacatgtcttgcaaacttgttgtatcagtcactctgtttttcagttttctcgccataggccctctcgctcatgcgcaaaacagcagcgagaaagaggttattgtggtttataaaaacaaggccggaaaggaaactatcctggatagtgatgctgatgttgaacagcagtataagcatcttcccgcggtagcggtcacagcagaccaggagacagtaaaagaattaaagcaggatcctgatattttgtatgtagaaaacaacgtatcatttaccgcagcagacagcacggatttcaaagtgctgtcagacggcactgacacctctgacaactttgagcaatggaaccttgagcccattcaggtgaaacaggcttggaaggcaggactgacaggaaaaaatatcaaaattgccgtcattgacagcgggatctccccccacgatgacctgtcgattgccggcgggtattcagctgtcagttatacctcttcttacaaagatgataacggtcacggaacacatgtcgcagggattatcggagccaagcataacggctacggaattgacggcatcgcaccggaagcacaaatattcgcggttaaagcgcttgatcagaacggctcgggggatcttcaaagtcttctccaaggaattgactggtcgatcgcaaacgggatggacatcgtcaatatgagccttggcacgacgtcagacagcaaaatccttcatgacgccgtgaacaaagcatatgaacaaggcgttctgcttgttgccgcaagcggtaacgacggaaacggcaagccagtgaattatccggcggcatacagcagtgtcgttgctgtttcagcaacaaacgaaaagaatcagcttgcctccttctcaacaactggagatgaagttgaattttcagcgcctgggacaaacatcacaagcacttacttaaaccagtattatgcaacaggaagcggaacatcccaagcgacaccgcacgccgctgccatgtttgctttgttaaaacagcgtgatcctgccgagacaaacgtccagcttcgcgaggaaatgcggagaaatatcgttgatcttggtaccgcaggccgcgatcagcaatttggctacggcttaatccaatataaagcacaggcaacagattcagcgtacgcggcagcagagcaagcggtgaaaaaagcggaacaaacaaaagcacaaaccgatatcaacaaagcgcaagaactcgtcagccagctgccgggctccgacgccaaaactgccctgcaaaaaagactggataaagtacagtcatacagaaatgtaaaagatgcgaaagacaaagtcgcaaaggcagaaaaatataaaacacagaaaaccgttgatacagcagaaactgccatcaacaagctgccaaacggaacagacaaaaagaaccttcaaaaacgcttagaccaagtaaaacgatacatcgcgtcaaagcaagcgaaagacaaagttgcgaaagcggagaaaagcaaaaagaaaacagatgtggacagcgcacaatcagcaattggcaagctgcctgcaagttcagaaaaaacgtccctgcagaaacgccttaacaaagtgaagagcaccaatttgaagacggcacagcaatccgtatctgcggctgaaaagaaatcaactgatgcaaatgcggcaaaagcacaatcagccgtcaatcagcttcaagcaggcaaggacaaaacggcattgcaaaaacggttagacaaagtgaagaaaaaggtggcggcggctgaagcaaaaaaagtcgaaactgccaaggcaaaagtgaagaaagcggaaaaagacaaaacaaagaaatcaaagacatccgctcagtctgcagtgaatcaattaaaagcatccaacgaaaaaacaaagctgcaaaaacggctgaacgccgtcaaaccgaaaaagtaaccaaaaacctttaagacttgcattccaggtcttaaaggttttttacattctaagaacatcgtacacaacctttttcccatccgcctcacaggcttttcatactattgctatacagccatgaacagcataaaatgaacgttattacagttatcaccacatatggcgggattgtgactgggcaggcaggcaagacccaatgatgcaaagggagtattagtgcctaaaaagcagggcattttaactcttcttttcgtgttgggctcataacggcgccttggacaacccctattctcatgctccgtcgtcgacgcgggcatttttgtcattttcagccggtatttctcacttttttcattttgattgtcaacttttcatttgatacgatgaacaagccgacttttcttcagcaaaggaggttttgattgcttgcataaagagattgcaaaagaattactgctgctcgcaggaggaaaaaacaatattatcagcatcagccattgtacgacccgtcttcgttttgatgtaaaggacgagacgaaaattgatatacatgccattgagaacctgcaaggtgtgcagggcacctttttccgttatgggcttttccagattatcttcggagcaggcgtcgtcaacaaaatatataaagaagtcgttcatgtatgggagaacgcgccttctgaagaacctgtccaccagaaaaaagccagccggaagctgaaccctgccgcagcttttgcgaaaacactgtccgatatttttgtgccgattattccggcaataacagcaagcggcctgctcatggggctgatcggcatgattaaggtgtttcactggttcgctgccggcagcccatggattaaaatgctcgacctcgtgtccagcacagcctttattttactgccgattttagtcggcttcagtgccgcacggcaatttggcagcaacccatacctaggggcagtgatcgcggggcttttgacgcatcctgatctgctggacccgtctatgctcggcagcaaaaccccgtcttctttagacatatgggggcttcatatcccgatgatggggtatcagggttccatgataccgattcttctctccgtttttgtcatgagcaaaattgagaagctattaaaatcgattgtgccgaagtcgcttgatgtcgtgatcattccctttattacggtcatggtgacaggatgcctcgcgctgattgtgatgaatcccgccgcgtccatcatcggccagatcatgacacaatcgatcgtctatatttatgatcacgccggcattgctgccggagcccttttcggcggcatctactccaccatcgtcctatctggattgcatcatagcttttatgcaattgaggcaacgctgcttgctaatccgcatgtcggtgtcaactttttagtgccgatatggtcgatggcgaatgtggcccaaggcggagcggggcttgcggtattcctcaaaacgaaacaatcaagcctgaagaaaattgcgcttcccgcttctctgaccgcgtttttaggcattgttgagccgattgtattcggggtaaatctcaaactgatccgtccctttatcggagcagccatcggcggtgctattggcggagcgtacgtggttgcggtacaagttgtggcaaattcctacgggctgacaggcattccgatgatttcaattgtgctgccgtttggcgccgcgaattttgttcattatatgatcggttttttgatcgcagccgtctctgcttttatagctacattgtttctcgggtttaaagaagagacagaataactggatttattcgttttcattcataaaacgggggatgaaaggacaaaaaagctatgaaaattaaaagaatcttaaatcataatgctatcgtcgtaaaggatcaaaatgaagagaagattctcttgggtgcaggaattgcgtttaacaaaaagaagaatgatattgtcgatccgtcaaaaatagaaaaaacctttatcagaaaagatacacctgactataagcagttcgaagagattttagaaacattgcctgaagtccacattcagatttctgagcaaattatctctcatgccgaaaaagagctgaacatcaaaatcaacgagcgcattcatgttgctttttcagaccatctttcttttgcgattgaacgcctgagcaatgggatggttatcaaaaatccgctgctgaatgaaatcaaagtcctttatccaaaggagttccagatcggcttatgggccagaacactgattaaagataaactggggattcacattcctgatgatgaaatcggcaatatcgccatgcatatccacacagcaagaaacaatgccggcgatatgacacaaacgcttgatattacaacaatgatccgtgatattatcgagattatcgaaattcaactgtctattaatatcgttgaagataccatctcttatgaacggcttgtgacccatctccgctttgccattcagcatatcaaagcaggcgaatccatttacgagctggacgcagaaatgatcgacatcattaaagagaagtttaaggatgccttcctgtgtgccctaagcatcggcacctttgtgaagaaggaatacggctttgaatttcctgaaaaagaattgtgctacatcgccatgcatattcagcggttctaccaacggtcagtcgcacgctgagacaaacaaaaaacgcttttgatcatctcaaaagcgtttttttatatctgtattattggttgatcgccggattcccaatcgtattccacttcgtataggacatgtaatggaaatactcatcacgatacggatgttttgtattggagttccaaggcttttctccgccgcagaagtgcacgattgccgggttttctcttgtttcattatattgcttccgccctaacagagtagatggggttttcagctttaacatgatataggtttgagcgttccagcgcggatgaagttcataccactgatcatataaaatcgcattcagtgcatcttggtcatgcagcacaagaaagtcttcgtctgggtgttcattgataaagttgatgactttttctgtgatgttttgctttctccaagactcaaaatcaataatcatgatacctgagttaaaatacttccctgtatcagtgacgttcatttctttcaggcgttcatgctgccccgcatcctcaacagcggctacggtgtatggcgcaatgtctaagtcccatagcttagaaatatcctctaggacaagcgcatcacaatcgatgtaaatcattcgtttgatgctttcatccttaattaagtcgggaatcgaaatgcggtaatacgcggcttttgtaatatggctgctctctaccgcatgttcatacattttggtatccacttctaaaaactcaatcggcactccgaatttcaaagtggtttcttccagtctttttttgttatcaggcttaattccgccatcaatgacgtataattttacctctctctcctgatccatgttagtcaataaagaaacgaacatcccacctaaatgacgagcataattatcatctgcgcatgatacgatatgcatgatttcatctttcctcaatggtattcatctccctttttgttgtacaagttacataccctttttcaaaaaaataaacacgttctccgacattttttaaaacagaatgtgtgatacaacaaaaaaggtgtcattttttgaagatgcgataaagccaataaagaatgaaaaagcttgcgattgtgatggcttcagccgagacgatataccacggccatggcccgagaacatctaagagagaggatccgcccggttttttcgtcaaatacatataattcgcgccaagccagcgatcaatctggaaaatacagacgccgtacacattaacaagcaggactgtcacccataacgagcgctggcccattctgtaggtgccaatcacagccatcagcagacaggataaaaacacagacccgtgagaaataaaaaagaggatatatcggatatgcggaaatgaaaacattccgaggtcaggagtggcaagagcctgaatcgaactgccgatgccggcaaaaaacaaaaacacaaacagctttctgctttttgtcactaacataatagctgacaaatacaccgacaggtcactaagctggagaggcaatgaagtgcgcaccgaccacctgcccgtggcgaccatccatatttgatagccgatttgcgaaccaagcaaaagaaacacaaacagagaacgcaaaaaccgactggccctcggctgcttgaccccattttggaacaaaaacaacagaatggccaaaagggcgataatcgctaacgtcactacatgctctgtcgaaaacagatgaaacggatcatgcttatagacggattgaacatatttttgcaaaactgcacccccgtttgcgggtttttgtttattttggcgttgtttgggctttttttattcaccgatatatgggcttgaagttcacatcagactctgttacaattcgtttcatagctaatgattctgataatttaaggcaggcctaaaaaatggaacgttcacatcaacatcagcagcttcggaaggaagaacacgatacactttctaagctcaaacaaatgcccgtcgagtcactcaacctggaagccatttcgatcgctacgaatctgtatcggtctgcgcaaaggctccgtgtcaaaatggagactgaggttctttcttcctataacctttcttggaccgctttctccattctttatgatctatgggtatggggagcgctcgaaacgagaaaaatcgctgagctgtcagggatatctacagctacagcaagcaacgtgatcaaaacgctcgaaaaaaagaatttttgccgtaaaagcatcgacacaagagatcggcgactcgtgtttgtctctatcaccgattccggcaaacaagcgatcgaagaactctacccggagtttcacaaaggggaaacagagctcattgcgggaatgacgaaggacgaacagaaaatattgacagggctgcttagaaaggtagctgacaatcttcatacaacataagctttgacgggaatccagtagcggtttgtctccctgtttcagagagccggcggaaggtgcgagccggcacacagcaaacgtgaattacctccccgagctttctttgtgaaccttaaaagtagcaaagaacgggaaaccgttattcgaatgagcggaagacaatgtcttcaaccagggtggtaccgcgtgcattgagccacgtcccttatcgggatgggctcttttttgtgtttgtaaaaaaggaggaagaatgatgataacatttgagcagctcacagcgtcacagcaaaaagaggtagaaagacagctacagctatacatgacaggcgcccacgaagtcataccgccggaggaattaaaggcaaagctcgtgaaatcaatttccacaggcacgccgcttaaaattaagctcggattagatccgtctgcaccggatgtacatttgggccatacggttgtgttaaataagcttcgccaatttcaagaaaacggccacattgtccagctgttaattggggatttcacaggaaaaattggtgatccgaccggaaaatcggcagccagaaagcaactgactgatgaagaagttcagcacaacgccaaaacctactttgagcaattcggaaaagtgcttgatccagaaaaagtcgagcttcactataactcaaaatggctgaaaacattgaatctggaagatgtcattgaattagcagggaaaataacggtagcccgcctgatggagcgcgacgactttgaagaacgcatcgccatgcaaaaaccaatctcactgcatgaattcttttacccgttgatgcagggatatgattctgtcgttctcgaaagtgatattgaattaggcggaacggatcagcatttcaatgtcctcatgggacggcatttccaagaacgatacaacaaagaaaaacaagtcgtcatccttatgccgctcttggaaggcttggatggcgtcgaaaaaatgtcgaagtcgaaacacaactacatcggcattaacgaacatccaaacgacatgtacggaaaaacgatgtcactgcccgacagcctgatgaaaaaatacatccacttggcgacagacttagagcttgaagagaaaaaacagctcgtaaaagacttagaaaccggcgcagttcatccgcgtgatgccaaaatgcttttagccaaaacaatcgtccgaatgtatcacggagagaaagcagcagaagctgccgaacactcgtttaaaacagtctttcaggaaaacagccttcctgatgatattccgtctgtccaatgggaaggcgagaaaacaatcgcgattgtcgatctgctcgttacattgaagctcctctcttcgaagagcgaggcgcgccgcatgattcaaaacggcggtgtacgcatcgacggagagaaaataacagatgttcacgccaaagcagagataagagagaatatgatcatccaagtcggcaaacgcaagtttttaaagctccaatagtctgatattccgaaacgcttatgacccttcattcataagcgttttttgcaggtataaagcactgtcttttcaaaaacgctcttcatcttgcaggaaactcctttagcatcccgaaatattccccaaccatacatttaggggaggtttatttttgatgaaaaagcttttgactgtcatgacgatggctgttttaactgccggcacactgctcttgccggcacagagtgtcacccctgccgcgcacgctgtacaaatatcaaatagcgagcgcgagcttccattcaaagcaaaacatgcgtactctaccatttctcagctaagtgaagcaatcggcccagaatagccggaactgcagctgaaaaaaagagtgccctattgatcgcctcatcaatgagaaaattaaagcttgatgtgaaggttcaacgattcaacattcctgaccggcttgagggaacactgtcttcagcaggacgcgatattcttctccaagcggcgtccggctcagctccgactgaggaacaaggactgacggccccgctttacaatgcgggattgggctatcaaaaggactttaccgctgacgccaagggcaaaatcgccttaatttccagaggagacctgacttattacgagaaagccaaaaatgccgaagccgccggagcaaaagctgtcatcatttataacaacaaagaaagcctcgtgcctatgacgccaaacctgtcgggaaataaagtcggcattccggtcgtcggcattaagaaagaagacggtgaagcacttacccagcaaaaagaagccaccttaaaactaaaagcattcacaaaccaaacctcccagaatatcatcggaatcaaaaaaccaaagaacatcaaacatccagacattgtgtacgtgacggcccattacgacagtgttcctttttcacccggagcaaatgacaacggctcaggaacctctgttatgctggagatggcgcgtgtcttaaaaagcgttccatctgataaagaaatccgctttatcgctttcggcgccgaagagctcggcctgctcggctcctctcactatgtagatcatctatcggaaaaagagctgaaacgaagcgaagtgaacttcaacttagatatggtaggcacaagctgggaaaaagcgtctgagctgtatgtcaacacattggatggccaatctaactatgtttgggaatccagccatacggctgctgaaaaaattgggtttgacagcctgtctctgacacagggaggatcatctgatcatgtgccattccacgaagccggcattgattccgccaactttatttggggagacccggaaacagaagaagttgagccgtggtatcatacccctgaagactcgatcgaacatatcagcaaagaacgcctccagcaagcaggcgatcttgtgacagccgctgtctatgaggctgtgaaaaaagagaagaaaccgaaaaccattaagaaacaaatgaaggccaaagcaactgacatttttgaagatatcaaataaaaaaagacggcacttgggtgccgtcttttttttataatgatcagctgtttagccgtctataagtaaagctttcagtttatcaactgtattttctttttctaacggccggtaaatggtcagtttcaaatcaggagagtcatatatttgtaatgtcatatgctccatcaccatttttccggctgccgggtgatgaagtactttttctcctgcgtgtgtgcctaatacttcgtggtggttccaccattttttaaattcggggcttctttcagttaactcatcgatcagctcttttatccatgcttccccaagaaaccggctggctgtcgatcgaaactgtgcgataagttttttggcgtggctttcccagtcgtcaagcagatcccgatactccttcgaggtgaaacatcgccatatggcgttcctttccttactgcccatttggccaaaattgccgaacacagcacaagctgctgtgttccaagcaataacgtcccacttttcgtcagtcacataaacagggcaattggttaaatgatcaataaagtgctgcacagctagaggaaggcacttattatcttcatcctgatcatctaaaggaacatgatggccagccaacagaaagacatgacgcttttcctcataattcaatttgagcactctcgatatgctttccagtacctgtgtcgatacccgaatatcccttccctgctccagccatgtgtaccatgtgacacctataccggacagctgggctaattcctctcttctcaagcctgttgttttccttctggtgcccataggcaatccaaactcttgcggagaaagctgtgcccttttaagttttaaaaactcccctagctctttccgtttttctgccatactgtccacatacacactctccttctgcatagaatttcctattagtattctacataaaaaggagaaggtttttatattatttgtttcgttctgcaaatacttcagcggccacaggaagaatggtattcagtgcattcggaaaacctgagtaaataatcatctgcatcatgacttctatgagttcttcttgtgtccatccgacattcagggctccgttaatatagaattttagctgctgggtattgcccaatgcagtcaatccagcaacggttgctaataatctggatttcagatcaagacccggtcttgaaaaaatctgaccgtagttaaactccacggcaagcacaccaaggtccggagcgatggaatgtttaaaattgtccacgatcgcttcatagttctcctcatcaatttgtttcagaatatctaacccttttttataacgttcacttgttcgcaccagcttctatctcccttccaatatcgcttttttagtagtgcgatttatggtaatccttgaactgaaggcaataccgaccatgatcatccccataatacaaacaccgttccaatgaaacagcatccagaccgcaccccctgcatacgatcccaaggcgccgcctaaaaacgtgctgaccataaagatgccattcaatctgcttctcatttcagccgacaatttgaaaatctccgcctgacacgccacctgattcgcctgaatgcccatggtgatgaataaagcgcccaatacaatcacaatcaatgaagtctggcctgccattaataaaacaaatgacaataaggtaaaagacatacaaagcttgttggaaaaagcagctcctttttgatcaataatccggccgatcagcggagttgcaaaagccccgccaattcccaccaaaccgattgttccggcattctggctgccaaacgaaaatggaggttcactcaccataaacactaacgtcgtccaaaataaactgaaggcgccgaacatgaagccttggtttacacatgcttttcttaacactttctccttgatcaaaagcggaaataatgaagaaatgagttttccgtaatgaaatgcatgtgtccctttgcttttcggaaagcagaagtgaatgatcaacataatgatgacggctgctgcacaggcaatccaatacattaagcgccagccataatgggcatctatcgccccgctgaccactctcgcccctaaaattccgcaaaccaagccgatggctacgtttccgagtacttttcctctgttcctgtcatttgctaaacctgccgcaaacggcacaaggatttgaggaataatcgtgaagaatcccaataataaatttgtgatgactagccatggaaagcttacagctaacgctgaagcggccgaacaaacccccactaagaatagcaggctcacaattaagcggcggcgttcaaaaagatctcccaatggaacaagcagaaggttccccgccgcatagccaatctgcgccaatgtagcaatcatcccagcttgtgccggcgtcacatgaaacgtgcctgccatgctgacaagcaatgtttgattgatatagacattagctaccgtaaacccgctagtcaccgctataagaaaaatcaaacctctcgataatgaaatggaatggttcatgtttacctcctttcccatgcatgataaagcaggttcaatcatggaaacagaagtgagtttatactggtataaaatgtactagcaagcaaagcaaaaaagcgaaaccctgtcaggcttcgcttttgttatcaatccacttctttcttaatccccagcattttctcatctaggtaatgggcaatctccgcggcttccttcagctcatctgttaattgcttaggaacgtcattgttcaatttataataaattttatgttcaaggctcgcccagaaatccatcgcgattgtccggatttgaatttctgctttgacgtattccacacggttcgttaaattcacaggcatctcaatgattaaatgcaggcttcgatagccattcggtttgggtgtctggatataatcctttacctttacgattctcaaatcttcatgctgcttcaacacattcacgacattataaatgtcagaaataaaggaacagatgatgcgtacaccggcaatgtcgtgaatatgctccttcatttccttcgtcgtaatctcacagccctttctcattaacttattcacgatgctttcaaagcttttgacacgggattttgtatgttcaatcgggttgtgtccgtgaatgaggttatattcctggctgataattgaaaactttgtatcgagcgcatctaacgcaaatttataaactaataattcatttttccaatcttccattactgtttttaaatcgtccatatgtgttacagataaatccatgttcgtcatctcctttaacggaactttatccgctgtccatgtactagacgtccctgtctgctgcaaggttctatgaatttttttacaaaatgcggtcgattgtaacaaaaaaaagaccgcacgaaacgagcggtcttttttattatcggaagtagctgatcaataatccgatcgagagcaggaatccgaaaaatgtatttgtttgggctgttgatttcattgcgacaatcatattcatcggcatttctttttggacgaagcccttcactgcctgaaccggcttaggcacgctcaaaaagacgacaaacagccatgggcttgcggcaccggtaataaccaagccgacaacccagatataagcgacggcaaacgacgcagctaacagagtaacagctcccttatgccccatcaaaatcgccaatgttttgcgtccgccttttttgtcctcttcaatatcacgaatgttgttcgacaggttaatcgcgccgacaagaatcgcaatcgggatggaaatcaaaatgctcagcatattgatcttatctgtctgaatgaaaaacgaaatcagcacaaacaccgaacccatgcaaatgcctgagaataattcaccgaacggcgtgtacgcaatcggcagcggcccgcctgtatacaggtagccgatcgccatgccgacaaggccgatcagcgcaagccaccagctgctgcttgcacaaatatagacaccgagcaaaatggcaatcccgtatgaggccagagctaattgcaaaatcgttttaggcttcattccgtggcgtacaatggcccctccgattccgactgattctgctgtatctaatccgcgtttaaaatcataatattcattaaataagttcgtcgcgatctggatccataggcaagaaaacagcatagccaaaaacagcagcagatcaaccttcacataaaacatcgccaaaacggttccgagcagcacaggcacaaacgatgcggttaacgtatgaggacgagttaactgccaaaggatctgccccatgctttctttttgcggcgctgtctgaccctcacccttatttgtttggttcatcttcctcttcctttctattaaaaggcttactttttttcagccggcagcttaataaaaaactccttttgcttccttatctatcataatgacttctcccttatttcacaagataccgcaagaaggcgttttctttcttattatacgcttccgccccgatttcattaggtttctgctttcacttgaacgaacaggtacagaaaaattttttaagtacattacactttttaaaagttaaaaagatcttttgactccaggtatcttttcctttattatgaatcagctcgaaacattccattcttgcccttgcaggtataaagattcattttcaaaaacatacgccgatatattaatttgagggagattagggaaaaaatgaaactttttgagcatctgatcgtcaaatactcatgtgattgtcgaaaaaacgggaagggaatttttgatatgctgcaattaatgaaacagctgtatgaaaaacccgctgtcaagtggacatgtcatacaggcttttatttgatgatactgcttgttttgttttttatgtatggttttcacaccgcgaataccggttcatatatttataacgatttctaattggagagagaataactatgaaacttttacatgctattcaaacacatgcggaaacttatccgcaaaccgatgccttccgctctcaaggccagtcgctcacgtatcaggaattatgggagcagtctgaccgcgcggctgccgcgatccaaaaacgcatttctggggaaaagaaatctcctatccttgtgtacggccacatggagccgcacatgcttgtttccttcttgggaagtgtcaaagcgggacatccttatattccggttgacctgtctattccgtccgaacggattgcgaaaattatcgaaagctctggagcagaattgctgatccatgcagcaggactctcaattgatgcagtcggccagcagattcagacagtttctgcggaagaactgctggaaaacgaaggcggctctgtcagccaagatcaatgggtcaaagaacacgagacgttttatatcatttacacttccgggagcacaggaaatccgaaaggcgtgcagatttccgctgcgaaccttcaaagcttcacagactggatttgttcagactttccagtcagcggaggaaaaatatttttaaaccaagcaccgttctcatttgatttgtctgtcatggacctatatccgtgccttcaatcaggcgggactttacattgcgtgacaaaggatgctgtgaacaagccgaaagtcttatttgaagagctgaagaagtccgggctgaatgtgtggacatcaacaccttcctttgttcaaatgtgcctgatggatccgggtttttcacaggatctgctgcctcatgcggacacatttatgttttgcggagaggttcttccggtttctgtggcaaaagcgctgcttgagcgttttccgaaagcgaagatttttaatacgtacggcccgactgaagcgacagtggctgtcacatcggttgaaattacggatgacgtcatcagccgcagcgaatcgcttccagtgggcttcgccaaaccagatatgaacatttttattatggatgaagagggacagccgcttcctgagggagaaaaaggagaaatcgtcattgcagggccgagtgtaagccgaggctaccttggtgagccagagctgacggaaaaagcgtttttctctcatgaaggccagtgggcataccgaactggcgatgccggctttattcaagacggtcagattttctgccaaggacgtttggattttcagattaaacttcacggctatcgaatggagctggaggaaatcgagttccatgtcagacagtcacagtacgttcgttctgctgtcgtgattccttatcagccaaacggaacagttgagtacctgatcgctgctattgtgcctgaggagcatgagttcgagaaggaattccagctgacaagcgctattaaaaaagagcttgccgcttctcttccggcatatatgatcccgagaaaatttatctatcaggatcacattcaaatgacggctaacggcaaaattgaccgaaaacgcattggcgaagaggttcttgtatgacgccttacagctcgtttttattctttatactgcttggcattcttcttctgccgacgatcattctcggcttaaacggaaaaagatttcaagcatacaacatgttcatatctatcattatattggctttaattttttcgcacgacttacacggggtcatcgcgctgtgcctgtttacaatatggcaggtgctcctgatcagcggctatctggcataccggcagaaagcgaacagcggctttgtcttttgcggagctgttatcgcgtctattctgcctttatttctgtcaaaaatatggccgtttctttcacacccgcagccgcatcatccgccgcataacctgatcagctttttaggtatttcatatttaacctttaaaggcgttcagctgattatggaagcaagagacggactgctgaaagaacagctgccattgcaccgcctgctgtatttcatcctgtttttcccgacgatttcctccggcccgatcgacagataccgccggttcgtcaaggatgaacagaaggcttggacgaaagaagaatacgccgacctgttgtatacgggaatccataaaatcttcatcggtttcctgtataaatttattatcggctacgcgatcaatacgtacttcatcatgaatcttcccgcaatcacgcacaataagattcttgggaacctgctgtacatgtatggctacagcatgtatttattctttgatttcgccggctacacgatgtttgccgtcggggtcagctacattatgggcattaaatcaccagaaaactttaataaaccatttatcagtaaaaatattaaagatttctggaatcgctggcatatgtctctgtcattttggttcagagattatgtgtttatgagattcgtattttggatgactaagaaaaagtggatcaaaaaccgtatggccgtctctaacatcgggtatttcctgctgtttatgctgatggggtttggcacgggctcgcgccgcaatatatcatctacggcctttatcacgccgtgctgatgacatgttacaacttttttgagaagtggaataagaaatataaatggctgccgtccaaccgctggacaaccattctcgctattgtgatcacattccatttcgtttgcttcgggttttatattttctcaggaaaaccatttcatcaccaccattaaaggagattagaaagctatggattttaaacaagaggtattagacgttttagcagaggtttgccaggatgacatcgtaaaggaaaatcctgatattgaaatttttgaagaaggtttgcttgattcttttggaacagtagaattgctgcttgcgattgaaaaccgttttgatattttagtgccgatcactgaatttgaccgggacgtttggaatacacctaacaacattgtaaatcagctgtctgagttgaaataatgaaaaagcgttttttcggtccaattattttggcgtttattctattcgcaggcgccatcgcaattccatcttcatggctgacaggcttcatcaccgataagcgtgtgaaagagtcagcaacagccttgaatccgagtatgtttcaagggctatatttacaagatcagatgctcaaagatccgacatatcttccgatttacgggtcttctgagctttctcggctggacgagttccacccatctaattattttcaggtaaacaatgagggattcacgccataccttgtcggcaaaggcggatcccagtcattgattcattctttaaacttcgctgcccatatggatcagctgaagggcaaaaaaatcgtattcatcgtgtctccgcaatggtttattaagcgcgggtctgatgaacagcatttcgcgccgaactattctgcgctgcaagggcttgatttggcatttaacgatcagatcgaccctgaaattaaaaagaaaatgatgaaacgcatgctgcgctttaaggctgtgcaaaacgatgccattctttctgagctgtacaaagcaatggtgaacggccagacgtggaaagtgaacgcgctgaagccggcggcgaaagtgtattacagcatgctggaaaagaaagatctgtattattcaacgacagaatcatccgggccaaagcgctatatctcgcagtcagtaaaggataagtcatggtctgaattgaataaactagcggatcaatcgggcaaacgccactccggttctaacgattttcacatcgacaaccctgtctataaaaagctgaagccgaaagtgcctaagctgaaagggaaaaacaaaggaagatcgtatgcggtgtcaccggaatatggcgactttgaaatgatgctcgatatcctgaaggatgcgggcgcagagcctatgtttgtcaccattcctgttaacgggaaatggtacgattacacgggcttcccgaaaaaaggacgcactgactattacaaaaaggtaaataaacaaatcagagcgaagggcttccaggttgctgatttctcagggcatgaatatgacccgtatttcatgaaagacaccattcacatcggctggaaaggctgggtgtatgtcgataaagcaattgacgaattttataaaaccggaaaagtcacttcatcctgagcatctcataggacgcggctgcatatttcctgctaagatttgaaatagtaaaggaatcacagccaacttaattaagaggtgttacatccatgaagatgacaaataatacggttttaatcacagggggttctgctggcatcgggcttgaacttgccaagcgcctgctggagctcggcaatgaagttatcatttgcggacgcagcgaagcgcgtcttgcagaagcgaagcagcagctcccaaacatccatacaaagcaatgtgatgttgcagaccgttcgcagcgggaagcattgtatgaatgggctttaaaggaatatccgaacttgaatgttctcgtcaacaacgccggcattcaaaaggaaattgactttaaaaaagggacagaggagctttttgtggacggtgatgaaattgaacttaatttccaagcgcctgtccatttatccgcccttttcacacctcatttgatgaagcagcccgaggcggcaatcgttcaggtcacatccgggcttgcgtttaatccgttagctgtttatccggtgtactgcgcaacaaaagcagcacttcactcgttctcgcttacgctcagacaccagctccgcgacacgagcgtggaagtgattgaaatggcaccgcctatggtggacacgggcttaaaccaaaaatcacgcgataaacaaggcctgacgtaccggggcatttcatctgaagaatatgttcaatatttcttggacggcttgaaggaaggcaaacaggagattacaaatgaacgtgttgaaggtcttcgggatgccactcgcgccgattatgacaggttattcgagcatatgaacacgcaggagaattaatttctcctgcttttttcatatgaatttcttacaaatttgagcaaacctattgcgattatttgttgaaggtatacaatagaatataattattttcaaataagtttgataatataaacaatttaacagcagggagattgaccatgactaaacaaacgattcgcgttgaattgacatcaacaaaaaaaccgaaaccagacccaaatcagctttcgttcggaagagtgtttacagaccacatgtttgtaatggactatgcggcagataaaggttggtacgatccaagaatcattccttatcaacccttatcaatggatccggccgcaatggtctatcactacggccaaaccgtgtttgaagggttaaaggcttacgtgtcagaggatgaccatgttctgcttttcagaccggaaaaaaatatggaacgcctgaatcaatcaaacgaccgcctctgcatcccgcaaattgatgaagaacaggttcttgaaggcttaaagcagcttgtcgcaattgataaagactggattccaaatgcggagggcacgtccctttacatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcggtaaaaggcggaacaggaaatgccaaaaccgcaggaaactatgcttcaagcttaaaagcgcagcaggtagccgaagagaaaggtttttctcaagtgctctggctggacggcattgagaagaaatacatcgaagaagtcggaagcatgaacatcttcttcaaaatcaacggtgaaatcgtaacgccgatgctgaacggaagcatcctggaaggcattacgcgcaattcagtcatcgccttgcttaagcattggggccttcaagtatcagaacgaaaaattgcgatcaatgaggtcatccaagcccataaagacggcatcctggaagaagccttcggaactggtacagcagctgttatttccccagtcggcgagctgatttggcaggatgaaacactttcgatcaacaacggtgaaacaggggaaatcgcaaaaaaactatatgacacgattacaggcattcaaaaaggcgctgtcgcagacgaattcggatggacgaccgaagtcgcagcgctgactgaaagcaagtaagaaaaaagccggcccattacaggccggctttttttacgcttcaattttgttgaaaaactgcggcagatacgctttgtgcgcctccagcatttcgtctaaaatctgtttggccacagtatcggacgggacaagcgggttaatcgtcatggcaaggagtgcagtttggtagtcacctgtaactgccgcttctgccgcgacacgttcaaaggatttgatttgctggacaaggccgcggacagacaccggcaagtcgccgacagcaattggcttagggccggttttcgtcatcacacagttcacttcaactgcggaatcgtctggaatactcgctattgcaccgttattgatcgtgttcaccggctgaatgtcgtgtttatcattgtaaatcgagctgattagattacatgctgcatcactgtagtaagctccgccccgtttttccagctgcggcggtttgatcgcaaggttcggatctttataaagctcgaacagctctttttcgaccttctgtacgacttcagcgcgggtgccctccgtttgtgatgcttcaagttcgtgctccagcatctcttttgttttgaaatagtaacggtgatagccgcaagggataacattgagcgcttttaagaaatccggttcccattcggctcctgagatatttttcatcgtcatcgcgtttttcgggtcgcccatcgcctcgatgacttgctccttcacacttacgccgtccaagaaaacatccagcccgaataccatatggttcagtccggcgaattggacttctacgcggtccacatctacatcaagcgctttggctacgcccattttgatgccgattggaacattacagagaccgacgactttcttcaggttggagtagcgaagcaaggcttctgttaccatgccggcagggtttgtgaagttaacaagccaagcgttcgggcaaagctcttctatgtcctttgcgatctcaaggatgaccggaattgtgcgcaatcctttaaacaggcctcccgggccgtttgtttcctggccaattacaccatattttagcggaatgcgctcatcctttgctcttgcctgcaaaagtccgacgcggaattgagtcgtgacaaagtctgcgtctttcagcgcttttctccggtcgagcgtaagatgaatgtcaatcggaacgccagctttttcaaccatccgtttggcgagtgtgccgacaatattcagcttttcttcgccctcggggatatcgacaagccataattcacggacaggcagctcatcataccgtttaatgaacccctccactagctcgggtgtatagcttgaacctccgccaatcgttacaatcttcaatccttttgtcatatgcttgctcccctttgctcggtgattttttcatataactcaatgatctctgcagccatatccttcactgtcattgcattcattaaatgatcctgtgcatgaaccatcagaagcgtcatttccgtcttttctccgcccgcttcattttggatcagctctgtctgataatgatgggcttttgacaattcttctgcagcgtcttgaagctttttccgcgcttcttctgcgtcgccgcttttcgcagcggcaatggcctccattgcggagcttctaccgtttcctccgtgaaggatgatttgaaaaatgatttgttccatttcctcattcacgcgattcacttcctttctctacagagccgcttctttgtcatctgatgctgcaggcgttttgaccagctccagatcgttttcttctttcagcttctgcttatcccacattctgaagaatggatagtagacaacaaaggacacggcaatattaatggcttgcatgaccgcgcctgagacttttcctccagtcgccaaatagcctgaaaagatcggcggcatggtccacggcactgcgatacccgccggtttggcgacaaggccggtgctcattccgatgtacgtgagtgtcactgtgacaagcggggtgatgataaacggaagtaagagcattgggttcatgacgatcggcattccgaatataatcggttcgttaatattgaagatggccgggccgaccgcaagcttgccgagctgcttcatttgtttgcttcgggcgcgcaggaacatcgtgacaaccagtgccaatgtggcgccgcttccgccgatattgacccagatatcgaaaaattgctgggtgaaaatcttaggaagctcctcaccggcttggaatgcgatccggttggcatccattgcgccgtaccaaatcggtgccatgacgccgccgacaatgtttgcaccgtgaaggccgcaggcccataaaagcattttgacggcttcggcgacaaggcttcctccaaggcttcctcccagaatggaaagcggagtccccaataaaacgcttacaatattatgaaggctttcaaacggtgtcgcttcaacaatcagccgggctgcccaaatcaggaagatgacggcaaagccggggattaacgcgacaaatgacttgcttaccgccggcggaacaccgtccggcattttgaagactaaattgcgctggataatgaggcggtaaatctctgtggacaccattgcgataatcatagcgacaaacaggcctttgcttcccatgagcgaaagcggaatcccgccgccaaccatgatttctttcgtcgcgccatccggcataaacggcacttgataaggtgttgctaataaaaatgccgcaagggaaatggctccggccgacaaggcatcaacgccgtatttctcggcgagccggtaggcgatgccgaacgcggcgacaagacccataatttcaaaggtcgcgtcgactgggtaggccagtttttcagaccaggagctgccaaacgtttttgccataaactcagcatatcccgggatcgggaggttgccaatgatgaggaaaaaggaaccgatgataatcaggggcatcgtgaggatgataccatcacgcagcgcctgcaaatgacgctgtcccgcaattcttcccgctataggcatgaccttttcttctaagatctgattgactttattcacatagcccgcccctctctatgacacatgtccaagctgttcagctgatttcagcacttccgccccgttgcacgtgccataatggacggtattaatgacgtctaccggaacccctttgactctcctaattttttgagctgcggaagcatgtaacggacttgcggaccgagaagcaatacatccgctttatcgatatgattttgtacagaatcgcctgaaactgcccaaatggtatagtcttttccctgttcctgcgcacttttttccatcttgctcaccagtaagctagtagacatgcctgctgcacaaacgagtaatatattcatgtaaaagaccccctagagtttgatcaattttgtaatgtcctgctgttgctatcatcatattatgaaatcgctttcataaacactcagggtttttccgcaggcaacggaaaaaaggtatatacaggctgtcagctcagcattttttggtcaaacacatccgaaagctcttgatacgaacggcatttgaccagctggttcaccgccgccgggtcatccaaaatgctgccaagcagtttatacatgctttgcaaatccgctttgttctccttttcgacacaaagcagacagacaaattgaactcgctgactctcccaatcgatcggttttttgagcgtacaaacggcccaaaacgttgttttcgtctgcggaacaagcgggtgcgggatggcaacaagattgccaaaacacgttggcgacatgtcttctctttcaaaaatggaatctatgatttcttcatcggcaaagccgcattcgaccgctttctgccctaaaaattgaatcacttcttcttttgagcgcagatcctcctgaaaaaaaacgagttcattttttaagtagcgattggctttttccttttcatcactcagaatagattctatttttgtaaagtcagttccgcctaagatggtgttaaccttcagtactggtacagggagctcttttttaatcggaatggtgctgatgacaaaatcaattgattcgtaggacatttgatcaagactataatattcagccgttccaagaatatcgagccgcttgccgaaatgggaacgcagtttttcgcgcagaagctgggcgcttccggcacctgatgcgcatacaatgatacagcgtttcggcggactttctgttttttttcgttcaatcgcggcgccaaagtggagagccaaatatccaatttcgttttcatgaatctcaatacccgtttgttcctttatcacgattccggcaatgatcccggcttcaaaagcgagtggataatgttccttgatcgctgccagcatcggatttcgaagattcatgccgtatcggttgcggctgatcgccggcttcatatgcagggccaagccgattttcagctctttgtcatgcaggatgccaagcttcagttcacgatcaacagctttgatcatggcaagtgtcagctgatcggtttcctcttctattgaaaatgtgtcctctccgcattgtgattgtgtcattcgttttgtgccaaggagatgcatggtgatgtaggccgtctcgtctttcggaaacgtaacggcaagcgctgattccagctcttttacgatggcttctgcagcctggtactccttttgatgcaggatatgatccatatctttcgggaaaagagaaacatagttttccgttctgatccgtttacaggcgatagcgatatggataatgaggttattcagtcccatgttggacagagggatgcggtcgtttttcatttttttcaagatggcggaacggatgatctcaatttcttcttttggcaaaatatcagccttttcatttaaaacatctatctccgtttctctttcatcaacaatgtactccgccatgcagtacctcatctgcacctcgtcccgcgcagcttgaagccgtaattcggacgtgtttccatgacgatgcggtaaggcagcagacgtttctttacttcctttaaatccgtttggagtgtagattttgagataaatagttcttcagcaagttcatcgagcttgagataatggtccgccagcagcagacgtttcataagataggccattctctcctccggcaataccggcaggccctttttttgctgaaatacatcttgcagcagtgttctgaatacttgctcgtcatcaatgcggagcttgtagccggagcctcttacagattgtacaaaggcaccgtggccgcttagcacaccttgcagttcctttatatcattgcggactgtccgcgtcgttacgtttaattgcgcggcaaaaaacgaacttgtcaccggggcttcagccgccatcagcaagcgcagaatatcacgaagtcgcccatgaagcatgagaaaaacctcctatctagtagatgcagggattcagtgaataggcagaaaggatgatgaagggatgcgaaatgtatataaattctataatggagagaatggcaagtcaatgagcatccggaggactagagggaaaactgacctataaaaaaacagccggggtcagccggctgttctagatgcggacatattcttttgtttagacgccttgcggtccttcatgatttttcgaacaatcgggtaaatgaccggcgcccatttgataacggttttgatcatctttttcaaagctccgattctcccttcttttttctcaaccattcccctgattgcctcttccttaaacatgctaacgcgacacgtacctgtttcccgtcacccagaaacgccatggataatcgcgtgcctccccgctgttgtcaatgccgatgcgcgggccggttgaaattgcttccggtgtgtacccgctttcgatgtaaagcggctgttccgtgatccagcgtccgtagtcattcatcgtgacgccaagcgctttcgtcagctttcctggtccgtttgtccattccctcggactcctgcccggccttctctcctccattaacagctggccttcatgcggctcaattgccctgattaataccgcttgcggaacatcctcttccgcggcaacgacattcagcaatgtatgggtgtgcatcacatatgtatatacccgcccagcttctgcaaacatgatctcagtccgcttcgtccggcggttgttaaagctgtgggccgctctgtcttcagcccccatataggcctctgtttccacaatatagcctgacgctgtgccttcgtctgtttcttttacaagaaggcagcccagaagcgatggggcaagctcaagagcggttttttgataaaacgtgatgggcagcggatttttttctctcgtcacgaatcgacctctccttttaccgatttttgtacattgtaccattcccgaagcagatcaaaaaaaacggctgttttaaaatctttccattcagggaatattgttaccgttcaaaaaaggagggccaaccattgaaagatgatcatcaaaacaagcagcaccaatcaaatgcccaagggagcgaggaagcgttttctcataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcgtacggaagcttcggagacgaaccgatttcaacatacacacgggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcggaaacaacctgaaaatcttttttatccgcgacccgctgaaatttccggatcttgtacacgcatttcagcctgatccagtgaccaacatccaggatggtgaacgtattttcgatttcatttctcaatctcctgaagcgacacacatgatcaccttcttgttttcgccttggggcattccggccaactaccggcaaatgcagggctcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatttatatgacgcgattgaaaatggcgattatccagagtgggaagtgtatgctcaaatcatgagtgatgatgagcatcctgaactggactttgatcctcttgatccgacaaaactgtggtataaagacgatttcccatggaaaccgatcggcaaattggttctgaacaaaaatccggaaaactaccatgcggaagtggagcaagcttcatttggaacgggagtgcttgtcgacgggcttgatttttcagacgacaaattgctccaggggcgtacgtttgcttattctgatacgcagcgctaccgtgtaggcgcaaattacctgcagcttccgatcaactcgccgaaaaagcatgtcgccaccaaccaggaaggcgggcaaatgcaatatcgggtcgatagagcagaaggacaaaacccgcacgtcaactatgagccatccattatgggcgggctgaaggaagcgaagcaggacggaaaagaccatacgccgcatgtcgaaggtgatgtaaagcgtgaagcgattgacagaacaaacaacttcggacaggctggagaaacgtaccggagatttactgaatttgagcggaacgaactgattacgaatttggtgaatacgctttctacgtgccgaaaagaaattcaggatcaaatgattgagaatttcacaaaagctgatcctgactacggaaaacgcgtagcagaagggctaaaaaaggtttccgaaaacaacagcaacgggccgatcggcacaactgaaacggaacaggctgcaaagtaggctgaacaggagagccatccatctgatccgtattaacaacagcgaacagggctttttttgaagccctgtttttttatttttctattgaaacgctttcaacaattgtgttgtactggaaggaaaggggtggagagatacgatggaattacagcaggacttgattcctcagaaaaaaacaatcggtgctttagatcacgccgtttttttatgcatggtattttgtttctggttttcaggctatatttacgttcctgtattcagtctgtatttggaggatctgcacttttcatatgggtcaatcggcatcattctcggcagctacggggtcacgcaaatccttctgcgattcccgctcggccttttgtcagacatcctgttttccttgcgcaagcaattgttaattgccgggttcggcttttctgtcctcagcagcctgctttttctgatgtttgattctttcttcttcgtgctggccgcccggctgttcgcgggaatcactgcttctatgtgggtgatggcgaccattttatacgcacattatttcaacaatggcaatgcatcaaaagcaatgggcatcatgcagttttttaccgtcatgcctcagtttgccagcattgtgttctgcgggctcgccgcagcccatttagggaggcaggttcctttttggatagcgctggcagcttctgcctcaggtctggtgatctgctgctttataaaggatccgtctgctcctcccgcaaaccgtgacattcgtgtcaatcagtacatcaaagatacattgcggctgccaaagctgaagcttttcaccatcctgtctatgacggcccatgccgtattatttatgacagtgtttggttttacgccgctttacatgaatcagctcggaatgggcgacgcggagctgctttgggtgatgagcgcctttttcctcccacacgcagccgccacattaagctttgtgtttctgcgctttacaagccgtatcgcttactccgtgatgctcattagtttcgctgtcaccggggtctgtttgctatatgttcctttttcagctgcattattcacggtttgcatcacacacgcctgtatcggactggcgctcggcttcgtttttcctctgttgctaagccatgtcgtcgaaatcagttctgcccgtttaaaaatgtcagtgatggggttttatcaatcattttatgcgctaggcatcttcctcgggccccttcttgccggaaaaatcgcacaacttgtcgggcttgcgggagttttttatggagccgggtttctggcatttgccgccttttttgtgatgctcgcgcaaaaacgtaacatgatcaattaatagctttcataccgctggaagcgccacacagaaaacacggccagaagcatgatgcacagaatggagaaagtgagtgaccatccgaaaaaatctgcccgctctccatgaagaaggatatgctccgcctgcttgcaaatctcagccggaagccacttcgcaccatctggaaataatgaaacagcaaaggaaacggctgctgtgagcccgatcccgcaagccgcagctgctccgacagaccggaatatcgtacttccggcaaggccggcggtcacaataaatatcacccaaagagcgtaaaggccaaggcttgcggcaaagcggctgaatgatgcgtcctcaaacagcagccggacgtaatagtaagcaagcccgtatccagctgcaaacgacataatgccgatcacgctttggatgaaccatttactcacgatataatgggctgccgtcacaggccgcgacataatcagcgctgttaccccttgatttctttcattggctacactgcccatcacgctaaagatgaccagagccatgccaagcgtgttgaattgagaaagcgtgctgaccatcacttcagacccggagggcatcgtaaaactgattttcatgccgtcaggaaggttccctccatgtgcgatgatttccggcatataataaatggtcagcggctgtgtcagcccgacgatcatcatcgcaatcggcagccaaatcagcttgccgcttttccatccttccagccactccttctgcaatagcgccgtcatcaccttcatgcgtgcaccacctttagatagacgtcttctagagactccgttttctgttcaaagcgggtgacggtcaatccctttcggatacagtcacttaataatgaccggccagcgtgtatatcaggcagctcgaaaaccgcttgggacggattcttatagacaatagctgagacgtaaggcttctcttcaagccaaccttccagcttctctttcactgaaagggtaaaaacgttcgtttgctgctgttgtttcagctcctgtaactcgcctttccatgaaatttcaccgtttttcataatcaccacttgatcacacacctgctctgcatcgtgcaaaacatgtgtagaaaacagaacggccatatgctttttcagctcccgcatcatgtccagcacctcgaaccgtcctgtcggatcaagtgcagacaccggttcatccaatatcaaaaacttcggtttatggagcagtgcctgtgccagaccgagtctttgtttcatgcctcctgaatagcccccgatctttttgtgcgccgcttcgtgcaaacccacaaattccagcatctcgccgatttcctcttggcattttctcttcgaaaggccggacagtctccccgcaaatgtcaaaaattcatttgcggtcatccaggaataaaaagctggatactgcgggaggtacccaatcaaacgccgatccggctttttttctcctaacagcttaatgtttccggaggttggcgaaagcagaccggccagcatttgcagagtcgtggttttgccggctccattgggacctaatagcgcgacacactcgttttcattcacgtgaaaactgatattctttacagcttcatgatgcctgtacgatttgcataatgattcaatagacagcatatcggcttacctttgctttctgccgacggtgaaaaataaaatcggcccgataatattgatacatacgatgattgcagcccacatccactttggcccgttcgtccgctcttcttttatacagctgataagggcaaacaccgccaaagccagctgtaatacaatcagcggcaaaatcatttcccaagaaatattcattgcttgatcccccttttcttccgatccggcctaatgacaaaaaagtaataacaaatcagaggcatcggtgcttgaatcaatccgacaatcccccaaacccatgccatgcgattacgttttttcgcatcaataaataaaaagattccctgcgccaatacgatgagacaagccgcaaccgttatgataatttctgtttgtgtcatccgcgtttcacctcgcattcgccgagatgcctttttttctcagccgcaatcaaaatcggcagcaccgcaagcacacaaacctgaagcacaataaacacagcaggagcttgagtgaaagctaagattgcagcactcacaaccatcagcgcgcagaatacaaataaaatgatctcttgaagaagtttttttctgtattcagctttcatttgtgacagctggtgaagcagttctttttgattcggtatagagggattggctgtttgatcaatttttttccattctgactttaaatgatcagaaagcttttctttattcatcgtcccactcctttctgatttgctggagccctttatgaactctggactttacagtgccttctttgatttgaagcatcaccccgatttcagcgtaggtatagccgtagtaatgccttaataaaaccggtgtgcgcagtttagggtccagctttgaaaacagatcgagcgtttcgctccactctgcccctttcgccgacacgtcccacttgatcttgcggattgtttcctccgtaactgtctgattccgtttccattctctctttctctttttctggtgatcgagatagagccgcgatgcaatggagatcagccatgtggagaattttgaacggccctgaaagcttcttaaatggatgtaccctttcagaaaggtttcctgaacaagttcctcgctgagatcggggtgaagggaaagctttaacaagtatttatataagaaagaatagtgatagtggaaaagggctgtaaacgcctcgtcgtttccctctttcgcctgctggatcagccgctgttcttcatgtgtatccaatgaccgtgatccccctttttgtttttctgccttatgagacgacaccggattcaaaagcgttcatcttttttacaattcttttcagccattgacagatcaggcttcccggccgtttggctgcatatccttatttgtaaaccctcttatagtctgttaagctatgactttatgtcgatttcaaaaaaacatccaatatggaggacgatgcattgaaagtagaaaggcgaacgattgaatatattccgaatgaagaaagacatggtaaagcgaaagatttatttcccgtatggttcgggctaatatgcatatcaccacgttagtgaccggcacgattcccgttgcaatgggacttaatctgttttggagtgttgccgctattatttgcggaaccttaatcggtgccatatttatggcgtctcattccgcgcaaggccctcagctaggcatcccgcaaatgattcaaagccgtgcccaattcggcgtaatcggagcgattcttcccctcttcttagtcatgtttatctaccttggtttcttcgcaagcagcacgattctggcggccggaaccttaagcagctttgttcccatcccgggatcatggagcattataggcttaagcgccgtatgttttttactcaccattttcggccatgatttgattcataaaatgcaaaaaatcctttcttggacctcttttgctgtattttttgctgcaacgattctcatttttcaattgccgattccggcagacagctggattcccggagcgattgatctgccaattttcttggtggcagtcagcgcagttgcgacgtggcagcttgcctacgcgccgtatgttgccgattattcaagatatctgccagttaaaacaccggcttcaaaaacattttggtacagctatgcaggtacatctgtcagctccatctggatgatgctgctcggcgcattgctgacaacctcactgcctgactttacggcaaactcaggcagccagattgtccaattgttcggtcccttctcgtttattatgctgatcattgtgttatttgggcaaatggcaatcaatgtttttaacctgtatggggccttcatgtccacgacaacaacgctggagccgtttctgaaattaaaagtcacgcccaaagtcagaatcatcatgatcctgggtgtcacgcttgtcggcacagtcttaagcctactgggacagagcaattttatggagctgtttttgaattttatctttttcatcagttatttcttaattccgtggacggcaatcaatttagtcgattactacttcgttcgccacggaaagtatcaagtcaaagccatgttcgacgtaaacgggccttatggaaaggtcaattggatcaccacaattgcgttcgttctgtctatcttgctggaaattccgtttatcaacacaagcttttacatcggaccgcttgccaaaatgtttggcggcggagacatcgcatggattatcggcttggccgtgccttctgtgctttactatgtattaatgaaaccgcgtctgaaaaaacgggcggggtatcaagaaaagctgtcttctctctgaagacagcttttttatcattcaaatcgtttccacacgcggggcaggatgtcagatagctcatgagcgagcaacgtatgagcggagtgctcgtccgtccagagctcggcgcacgcaccatgcaaatagaccgcgtttaatatggcgtgctttggatcttcatggcagcagagcatccccaatatcatgcccgtcagcgtgtcaccggttccgcccttggcgagcgccccgtttccggttggattgagccagcagtctccatcaggaaacgcgatgacggtttggtttccttttaacacaatgacagtctgcagctgagccgcccattcctttgcatattccgctctttttttctgcaattcgttcacgggcacccctgtcattcgggaaaactcgcccgggtgcggcgtgaggatgacgagggcctcccgtttcggatatgtgcgcttcgccagcgctccggcatccaaaataacaggacaatcagccgcaagcacatgatcgactgcctgctgtacgctttccgtttgcggaaggcccggtccgatggcaatggcccggtacgtctcttcaagctgagcatccgccgcctttttccagccgtcacgccaataggtcgcctcgggcaaaacaggaacaattagcgggattacgctttctgatgtaccgatgacaagcttgccgagaccgctccgcatggccccaagccctgcaagcagcgctgcccccggcatgtcgtcacttccagccagcagcaaagccgtaccgtacgtgcctttatggctctccgcatctctttcaggaagcgtggcccttacatgctcttccgtccaatatggaacattcatctctatccctcctctgctttcttttcctatttttcctgtcccttttctttttcaaacaaaaaagacagccttttagggctgtcttctattttacaggaacatcaaggtgatacaggcggctgtaccgttcgtttgccgccagaagctcctcatgggttccttccatttctgttttgccgttttcgagaaatacgattttatcagccgcttccactcccgcgagatggtgggtaatccataaaatcgtttttcctttcagcacctcaaacaccgtttccatcaattcacgttcggtaataggatcgaggccgactgttggctcatcgaggatgatgatcggtgtatcctgcagcaaaatcctcgcaagtgcgatccgttggcgctctccaccggaaaaacggatgccggtttcttgtacagaggtatgatatccatcaggcaatgactcaatgtagtcatgcagcttgacctgctttgcggcgcggcgcacatcctcgtcgcttgcttctccgtttccgagcctaatgttgttcaaaatgcttgtatcaaacaggtgcggtttttgatttaacacggccaccgcatccgcaatctgatcctttaacagcgctgtctccactccgtttaacgtcacagaaccggagtccggtttcaaggcgccttcgattaatgcaagcgatgttgatttcccagagccgcttcggccgagcagcgccattttttctccttggcgcagcgtaaaggaaaagttgtgcagcacttggctgctgttgtcataagaaaacgtcacatcacgaaaggccaaggtgacatcttgaagatcgagcatttgatcccctgattcagtttgtgacgcctccagctgaggagccaccttgttcatgcgtctgatagaatcctgatagcccggcacttcgcctaaggcatccgaaagcggcaaaaaggcttccgtcaacggaaacaccactagcacaaaagcggcaatcatcgttttagcgagctcgccgtccgcttgctgtcccgctgtccaaaacagcatcagcaaaataaggccagcgacaaggcattgcgcagcaaagtcccgccatcttgtaaagcgttgttttttccgttcaagctcaaaccaatcatgttcctctttttcataagcatcaataaaagcatgccggcgtccgctgaacatccagtcactgacacccatcacagcatctgtcagacggctgtacagcacattccgtccgcttttcagcttcgcattcttcgctctcgtcacgagcaaagacacaaccggaaacaatacaacaagaacaaacaaatacagcgcaagcaatatggcaaacggccaagagaagaagccgagcgctatcactgacacagcatacaggagcaaggctgagatcgcaggaaaaatcgtttttaagaatgcatcctgcaaatgctcaatatcctcagacaaaatgccgagcatatcccccgtgcgaaaacgggaacgcagcatcaaagcacccggctcaagcatattgtaaaggcggacgcgcatgtcggatacgattttcaaaatgatgtgatgcccgacgagccgttccacatatcgcgatacagaacgcgcaatcccaaaggtgcgcactgcgacaatcggcacataaatgagcagaatgttttccggccttgtcgccgctttagaaatcaaaaaccctgaggtgaacatgagaaaagcagcagaaaaaatcgtcaccgcgcccaaaaagataaccagaacaaacaggcgggcattttgcttgatatacggcaaaatccattcttctttcttcatgctctttcccccagttgcgccttcacgagtttggtatacacaccgtttttctccagcagttcattgtgagtcccgacttccgcaaccctgcccccgtccagcacgataatttcgtccatatcgagcatccagtgaaggcggtgagtcgcgagaaaaacgagcttatcctcaaataaatccaccatcgtttcttttatttcatattctgtttcgatatcaagatgagcggtcggctcatccagcagcaggatcggacggtttcccaaaaaggcgcgggccagcgcgacacgctgtgcctggccgccgctgagcgcccggccgccttccccgatccgcccctctaatccttcaggaaggctatccaccagctccgccagtcccgccgccgcagcagcacgggctgtatcctctgccgaagcgcttgggtggtagaagcgaatgttattgccaagcgtatcatcaaaaatgtacggatgctgagggatgtacagaaggtttttctgccagctgccgtcctgcaaatgggaccggcttgtaccattaacctcaatcatcccgccatccggctctaaaaatccgccgagaatatcaattaatgttgattttccggcaccgcttgcaccgataatgccgatttttttcttgcccttgaatgagagatgaatatcagacaccgaacggccgactgacacgcctgacagcttcagctcatcctgatcggaccaagcctcgagctgaagcggcgtctcttctttaaaaccaggctgcgacaaaatctcttgaatggtttttcctgcttcctggccgttcagtgttgcatgataatcattccccacttcccgcaccggcaaaaaatactcaggcgccagaataagcgccgttaaagcagggccaagcaaaatatcgccgtcaataaggcgcaggcccagaaatactgcgactgtcgccaccgacagcatcgtgaaaaaatcgagggcgaatgatgacaaaaacgccacccggagtgtgctcatcgttgccttgcgatatcgctcactcacatagaaaatatttttgctgtgtgacttgctcaaacctaggaaacgcaatgtctccagcccgcgaagagaatcaacaaaatgattggaaagtctctgataggatttccactgacgatccgcttttctctgcgcgacaaggccgaggagaatcataaagatgatcagaatcggcatagccgccactaaaatgatggctgatgtgcgatcctgaaaaaacacataaatgacaaccgccgcaggcacaatcgccatgctgaccattttcggcagaaacagctccaggtagcggcggaactggctgatgccttccatcgccagcgtcaccatttgccccgtcccttctttctttgcaaagcggggcctaatcggaacagctgatcaagaaaactttttctcaaatctgctcctgtccgggcggcgtattgatagacgattttctgtcgcgccaccgtcaccccgtgccgggcgataaaagcgatgaggaaaaagctgatcaccggaaaaagagaggtaatgcccttcccgttgaacagtccggttacggcctcactcagccactctgcctgcataataatggcggctgtctgaatcagcgttaaacaagtaatcaaggtgagaatccgcttcattcctttatatcgaaacaggtcttttcccattaataagtcataggctccttatggctgacgcgcttccggaagacataatagctccagatctggctgccgatgacgaacggcaatagcgttaatgctgcaattgacatgactttaagcgaataatctccggaagaagcgttagctactgttaaatcgtatgcgctatgaagcgagctgaccattacacgagggaatagggaaataaagatcattcccacggtcagcgccagaccagcgcctgtcatcccaaatgtccagccgtcttttttcttacgaataaatacagccgcgagcataaagcagatgacaatcaaaacagtgagcggaatggtaatctcgccgcggcgtgtaaacatgtctgtctgatacgcagaaagggccgcgaaggcaagaaccgctacaaaaacaacacccattatcttttgcgccattttccgggcgcggttttgcaaatcaccaatcgtacgcagcgtgataaacattaatccatgctggaagcaaagaagtgttaccgtcacaccgccaagtatagaatatacattgatataatcagatacatgtgcgtgaatgttcatgtcggcatcaatcggcatcccgcggaataatgtcgtgaacagcacaccaagcacaaacggaggaatcagactgccgaagaaaacgacccagtcccaaacctttacccattttaaatgatccaccttgccgcggaactcaaacgcgaccccgcggcccattaacgcaagcagcactatgacaaacggaatgtaataaccgctcagcatcgttgcataccagtttgggaatgccgcgaaaatggcgcctgcgccagtcaaaagccacacttcattcgcgtcccagaacggcccgatcgtgttgatcagcactctgcgttctaattcattatggccaagaaaacgggtcgccatgccgaccccgaaatcaaagccttccaaaaagaagaaacctacaaacaatacggcaacgagtataaaccaaagatcatgaagagatgccatggtatacctcctgactaaatggatctgttgatacaggaacatcatgatgatcactatgctccgcaccttttttaatctcacggataaacaagaagacaagcagtgcaccaagaatcatgtacatcacaccgaatgcgatgattgagaataacaaggagcccgctgttacgttaggtgacacagattgagcggttgtcattaaccccataaccgtccaaggctgacgtccgatttctgtcataatccagcccgcggagttcgcaagaaacgggaaggaaatcaacgcgatcatgatgcgcaaataccatttgctgtcttcaagctttttgcggcggtttaaccaaaggccgcctaacgcagcaagaatcatgacaacacctgctcctaccatgatgcggaagctccagaatgtcgttttcactggcggaatgtagtcgccttttccgtatattttttcgtactcagcctgaagggttttcatccctttgacacttccgctgaatttctgataagccaagtagctcaaggcataaggaactttgatttcatttgagcttttttcattttttgtatcgatcgtcgcaaaagcggtccaagcagcagggtcaccgctgtcttcccatagaccttcactggcagccattttcatcggctgtgattccatcaagtgctcagcctgcatgtgtccgctaaggccaacgccaagacctgcacaaaggccgacgatcattgcgagtttaaaagattgcttaaagaacggcacttcttttttcttcagcagtttaaaagcactcactccggcaataaagaaagctccagtggcaagcgcaccgaaaataacgtgcgggaattcaacccaaagctgagggtttgtaatcaacgcgccaaaatcattcatttccgcgcggccgtttttgatcgtaaaaccgaccggctcctgcataaaggagtttgctgttaaaatccagaaagatgacatgatcgttccgaatgatacgagccatatgcagagagcgtgaattttcttcggcaggcggtcccagccaaaaatccataatccgataaaaatagattccatgaaaaacgccaataatgcttcaatcgcaagcggagcgccaaatacatctccgacaaaacgggagtaatctgaccagttcagtccaaactggaattcttgcaaaatccccgttacaacaccgactgcgaaatttattaagaataagtgtccccaaaactttgccattttgagatacagctcatttttctttacaagataaagagtctccatcaacgcaaccataaacacaagcccgatagacatcggcacaaacaagaagtgaaacaacgttgttgatgcaaattgtatgcgggctaataccaattcactcatgctttctcctccatttccggttaaaactgttaatttgctcactacttcacaaatagaaccgagactttgatcagtaattcacaaaatagacgaaaaaaatattgttcaatatttcacaaacgtgtcaaaaagtcgtccaatatgaggcaagattgccagactgaccaaatgacacaatctctgactggttcatattaagtactttacaacgattcatttcaaaaataaagcctaaaatacctaaaaagtcccgcactatgtgacggatttttgtctattttgttgcttatttatgtcggctgctaggataaatgaccctttattatcgtacatcaacacatcgttccttgcgaacaaaatgcttgccctgcaccagcactcgtttctccgcactccgtcataaacagattttaggcaggatgcctcttttcatttgaaccggcaagtggagaaaagttgaatagtaaatttttaatatattaataatttcaattttttagtatacttaacatagtgaacaatttcactgcatcaagaataggggaggtttttcaatgggagagcttcaaacacacatgcaattgcaaacggatacaattcacgaaggggttcgaaaagagaattggtttgcgaaagccatgaatataaaagtaggcatcataccgcttcctgtgtatgccttgctgtttatattaatcactgtttttgttatgcatcacgatgtaaaaagtgacattttgacatccattgccgtcatggcgtttttcggatttacctttgcccaaatcggcaaatcgataccgattgttcgttctatcggcggcccggccatcctagctacttttattccgtccgctgtcgtgtactatcacctgctgcctaatgatatcgtcaaatccaccacagaatttacagaaaactcaaactttctatatttgtttatcgccggtattgtcgtcggaagcattctcggcatgaaaagagaaacactcgtaaaagcattcatgaaaatctttattccgcttattgtcggttctgtcacagccgctattgtcggactggctgtcgggacattgctcggactcggatttcagcataccctgctgtacattgtcattccgattatggctggaggagtcggagaaggcgctatcccgctgtccatcggatattctgacatcatgcccatttctcaaggggaagcgtttgcacttgttctgccatcgattatgctgggcagcttgtgcgcgattattctagcgggattgctgaaccgaattggaaagaaaaaaccggaatggacaggcaacggcaaagtggaccgctccgaagaagagtcccctgcgctggaggaatcacaaagcggacagcaaatgttcaacctttctttatttgcgtcaggcggtatccttgctgtttctttatacttagtcggcatgctcgctcacgattttttcggttttccggcacccgttgccatgctgttactggctgttctaatcaagctgttcagattggtgcctgcctcaattgaaaatggcgcgtttggagtgtcccgcttcttttcaacagctgtgacctacccgcttctctttgcgattggggtatccatgacgccgtgggacaagcttgtcgccgcttttaacctcagcaatattattacgattctgtctgtcgttgtgaccatgatggccgttggcttcttcactggaaaatggctgaacatgtatccgattgaaaccgccattatcaatgcgtgccattctggacaaggcggcaccggagatgtcgcaattttaagcgcggcggaaaggcttgagttgatgccgttcgcccaggtatctacccgcatcggggcgcgattacagtatccttaaccttattgctgctgcaccaattttattgatacacctcggagcaagttcttcggaaaacgaaagagcttgcttttttgcatgtccgtgtttttgcaagttcccatcccatgctatagtaatagttggaaatactagatagaaaggaatctggcatgcctatgggaactcatctatttctctttatgcttctcgggcttggattttatttgatatcagccctggctgcaaaactcattccggccatagacttctggattgatattgttctatgggtcggcgctgcagtttacatcttctctcatctctcattcatggacggcattgtctcaatcgcgacaatgttctactgctattggaccgcaatggatctcattgtttcagagcgtgcggaaaaaccttcgggagactggcaggagatcgagctggccagaaacaaaacacgcctcctgtcagacattgcactgaccgccgttgtgtttgcgggcgctgtcatttttttcatctatggacctgacccaagccccctcaaatatgtaatccttttcggcatgatctccggcggaggggcactggtgaagcgtatactgaatgttttcagcgtaaaggttttttattcagctgccttagaaaaattgcatatcagctcacactatgaaacccgtacatacccgctttccgatttgaaggatattcagcttgaatcaacggcagatctcttaaagctccatccgcttctgacgatgtattcatcccgtttagatttgacaacaagctttcagcaagtcattaaactgtctcttcccggcgaaacactgtttctgacggtgaaggaaccgcaaaaatggaaaacaattctccaggaatacacagatgcagaaaacaatgtggacaatgtgatttctgttttgccgttttatcatagaaaaaatgtgaagcggctgctcgggaagctttattttgccgccagcgtaaaaggggtatccgcttacgccttattggtgctcgcgttatacgcattacacgcctctccatgggtcatggctgttgccgtaatcctatattgggtattcaacatgtatatgtcagaccgtgtgttacgggcggcaatggacgccaagccttgtcatcatccgcatgtacaggcagcggccgataagattttccgatcggccggcatttcccatgtccgcatatacgaaacggagagtgatgattacaacggaatggcagtaggcatgaatgtcgggaggtcaatggtcatcctaacaagcgccacactaacacttccacagcgtgtcattgaaggcattctggcccatgaggcgattcatatcaaaaaacgtgacgttctgtcatcacagcttttgcgttttctatatcttggagctgtcgttgggattttcctcttatttgagcagcatatcacccatcccgaggcccacaaaattgcgctttgggctttcattatggcaatcattatcctgttccagctctatcaatccttttgttcacaatggatggaggtgcgtgctgacaaccttggcgcatcattgctggggggcggttacaaacaaatggctgaagccttaagaatcttggcggttcggcaggatgaggacatacagaaacaaagtgcctacagctctgaagcaggtgaagacgagcttcaaattgattctctcacccgtgataaaagctggtttttcagattgattgattttcagttcgctcctcatccccctatgtattggcgtgtcggcactttattgtcaaacaaaggacatggggtgctgaagcgctggctcagagaccgcctgaaagaatcgatcactttgaaatgaaaccggtcagcgtttcatccgtataacagatatggtgaaaaaagggagtgacgcgaagtgattgtgatcatcttattgtttatatctattattgtttttctttcagtcattcagccgcagccatcggaaaataaaagccgccagcaggcggacagcgggtatttcggttattcagacaacggctcacaccatgatggatgcagcagtgacggaggtttcagcgattccggctgtggcggcggagggggcggcgattaaacgccgcctttttttatttcattgattcgatgtacgcaccaaaagccgagcctgacatgcctggggacacgcgcacacgatggagggcatacattccctggtctcttgaagccgcgcccggttctgtcgtcacgcccatttgatagcctgttttttcagcggtcttcagcgtctcctcattgtagcgccctaccggatagctgatgagggaggtttgctgatgaaacatgttgtcgaacagctttttcgaatcagccatctcgctttgctgctgttgaggcgttaatccgttcagctcaaggtggtcaatcgtatggctttcaatcgatatgccgtgctgtgccatttccttcatttgttcctctgtcagatggtgcttatgtccgatcgatttgccgatcataaaaatcgttgccttcatcccgtactttttcagcaccggatacgcatcttgataattgtcggtgtacccgtcatcaaatgtgatcaatacgcatttctcactcggttttttatcctgcgtcagcatgagatatgcctctttcggtgttaatgtctgatagccgttatcatgaagccacttcatatgcgcctcgaattctttctttggcacacggaggctgtttcctgaagaaatgctgtggtacatcaaaatcggcagctttgccggtttctctgttttgatccatgcggatgtatcgtcttcttttttctgaacttgtactgcctttttttccggtttcttttgttccgcttttggcatcggctgctctgcattcgcctcttgatcagcgcaagccgcaagagccaaacagctgcccaaaagaaagatgcttaaaaacaatcgtttcatcgttctcctgctttctgtctatttcttcctcctttttcatcggtttgattctgagattttcaatagcaaaaaaccggacatgtctccatgtccggtttttttgatcttatcgaattctcacttctgtctcactgtcaaagaaatggcctttattcatatcaaatgcaaccgtcagttcatcgcccgattgaatatcgaggcgggcgtcgatccgcgcaataaagtcttggttgtcgatctgcgaataaatcatgatttcagaaccgagcagctctgcaacattgatcttcgccttaatcgaagagttcttatatgattccacgacaatcaattcatcatgtatatcctcaggacggatgccaaagatgacctctttgccgatgtagcctttttcacgcagcactttcatttttccttccgggacggttaatgccgcagaaccgattttgattaagccatccgtgagcttccctttgaaaaagttcatcgccggtgatccgataaacccgccgacaaagacgttttcagggaattcatatacatccttcggcgtcccaatctgctgaattttcccatctttcatgactacgatccgtgtcgccatcgtcagcgcttctgtctggtcatgtgtcacataaatcgttgtagtttgcagtctctggtggagcttaatgatttcggcccgcatttgcaccctcagcttcgcgtccaggtttgacaaaggctcatccatcaggaacacctttgcatcccgcacgattgcccggcccagcgcaacccgctgtctctgtccgcctgacagcgctttcggtttacggtgcaaatattcctccagcccgagaattttagcggcttcttctactctttttttgatttcaggcttcggcattttccgaagcttgagcccgaacgcgatattatcgtagaccgtcatatgcggatagagcgcgtagttctgaaataccatcgcgatatccctgtcctttggcgctacatcattgacccgttttccttcaatataaaaatcgcctttcgaaatttcttcaagtcctgcgaccattcgcagcgtcgttgatttcccgcagccggacgggccgacgaatacgataaattccttatcggcaatatgaaggttaaagtcatcaaccgccggttccttttgatcataaaatttataaatatgctccatccgcaattcagccatctaacatccccctttgttattgtaaacgctttcttatattgagtgtaacagcaattccctctcgctaaaatgggcagcgttcataaaatcacccagccatttttcgtgcatatttccaatttattctgaactttcattttgcaggcagataaaataggcaagaagcgcgcctttgtacgatttgatatctatccctgaccgctcaataaatttatcaatccgatattgcaggctgttgcgatgcagatgcagctttttcgctgttaatgtgacgtttgagttgttttcaataaacagcttaatggtcttccttagctcagcttcacttccaaataaaagctcagcttcttcagagagcagcgtttccagtttttctttttctgtttctaataatagaaaaggaaagatcatctcaaaggtcacactctgcacctgaggcagccgtttttcagcaaacaggaaatacgcctgttcacgagcataatgttttcgcagacactcatccggctcgtaaaatcttccggcgtaaaaacggacactgaagtagaaatcactttcaagaaccttagcgagcgattccagttcgtccttctccgccgtcgattcactttcctgctcgacaatcacgcctctgtcctcatggatccacacaatcacaaaagacaccggccaaaaatggcgaaccgcttccgtaaaggacgtcctttctattttgccgaataaatgaaagtgaacaaatctcgtccgtttctttatatacgccggcaattcccctctgaaaaaaagaacgaaaaccacttgttttcctcaggtgatttcatagacagttgattgccctcatccgcaggcgtcaaaaatgactgcagcaccaatacttctttttcactgatctctgttttcggaatggagatatatctctgattgctctcatcaaaaaaacatagacagccttcccttatgcaaagctcctcagacacaatcgaaccgggataaatagccagcagcgatttcatagagtctcctctcttatgtaaggatctgtatattcagtataaggcgaaacacacatgttctccactaaaaaagagtatatccggtatagatagacgagaaactgaaagggaaacctcattcgtttacatattggcttcagcggaaatagaagaggatatgcaggaccaaaggagggtcatcttatgagtttcgaaacgttaaacaaaagttttatcaacggaaaatggactgagggagaaagcggacgtacggaggacattttgaatccgtatgaccagtctgtgatcacaacagcatctttggcaacgggcaaacagctggaggatgcgtttgacattgcacagaaagcccaaaagagtgggccaagagcacaacggaagaccgaaaagccgtcctgcaaaaagcgcgcggctatttacaggaaaaccgtgatgacatcatcatgatgatcgcccgcgaaactggcggaacgattattaaatcaacgatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagcgttgtccacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacaggatcaacagcagtcgggcgccacatcggtgaaatcgccgggcgtgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgatcaacgagcgccaaatcgagaaagcgctggagatcattgagcaggcaaaggcagacggcattgagcttgcggttgaaggaaaacgcgtcggaaacgtgctgatgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctaatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaaatgaaaaaatccctctgtttcaagtacagagggatttttctttatttagatatatccacaaacccttcgccaaacacatcgcgtacgtcatgtacgatcacaaacgcttttttgtcgcagcttctaatgatttttttcagcatagacagctcctgtttgttaatgacgatatacaaaatctcttttgactggcccgtataatttcccttccctgataaaatcgtcacgccccgatccatcaaggtatttacctgctctgcaatctcactcttattttctgaaatgaccgtaatggcttttttcgtattcaaaccttcaataatgaagtccatcactttggtaccgatatacagcatcacgatcgtaaacatcattttttctgcaccaataataaaataagagctaaatactacgattaaatcaaaaaacaagagtgcatagctgatattccaatctaaatatttattagcaattctggccaaaattgcggaaccggctgtcgtcccgccgacccggataatcatgccgatcccgactcccgcaaatacacctgcgaaaatcgtattaatgatcaattcatcagacggaatgctccacccatgtgtcagatgaagaaaaagcgaatttgccgcaaccgcaatgatcgtataaaccgttgtttttccatccagaaacttgtagccgattaaaagcaaaaacgcatttaagataaagttcgtgacaccaggagaccattgaaacagataatacaatatcagcgtaatcccagtgactccgccttccccaagatcattgggaatcgcaaataaattaaccgcaagcgcgaagaaaaaagcgccaatcacaagcataagtacatccaacattctctttttcatcacgaaaacactccttctcattgttctgttctagcaaataaaaaaacccaggagaacgctctcgaaaaagagcagaaactcctgggcttttatcccaccgtgtcataacagccaagctgctatgtgttttctctcggtcacagtccaatttgcattgcggaaccctagaaaaccactgtttttatcatatccttttcactttccaatattagcattataagggacggttcgaattggttcaaggggtatttgcggagttttcatcagataagctggaagaaaaaaacgatttatctattaaaaaagaacagatatagccgataagaaaaaaagcatatattttacaagtaaatttaactataaatgataataattatgagaaattcataattttatattgactaagtgaaataatataggcattatagtacatatgtttcgtacattttattacataggaggaaatataatggcaggaaaactagtaccctgtaaagcttgcggtcaagaaattgcaaagggtgtaaaaaaatgtcctaactgcggtaaggatcaacgtaacttttttatgcgacataaaatcattacgtttattctcgcagttgttgtcatcattattatcggtaatatgattggcggcggaggcggttcagaagccacttccaaaacatcaagcggaagcaaagcagaaactgaaaaaacatacaatatcggtgatactgtaaaaactgaaaaaactgaagtgacagttacgaaggtagaggacagagatactgtcggtactcaatatgttgaaaagaaagcatctgatggtggtacaattgtagctgttcaatatacaattaaaaacgtatctaaaaaaccgattagctctttttcaattccaactgttaaattagttgatgctgatggtacttcttatgattctgatattgatgcttctgtaaactatgcaactgagacaaaagttgataactctaaaattttgagtgatctaaatcctaatattaaagtaacaggtgtaaaagcatttgaagttgacaaggaagcttatgcaaaaggcacttggaaactaaaattcagtaatgatgttattgtgaaaatcaaataacagctaacaagggtgcctgttcaggcacccttgttctttaaaggccttctctattgagaaggcctccattcttattccgcactcttatacccattcacatttgaagactgccatctccaggaatcagcacacatttcctcaaggccgcgtttcgcttcccagcccagttcccgcttggctttcgcaggatctgcaaagcatgtggcgatgtctcccggacggcggtccgcaaaacggtacggaacctctttccctgacactttttcaaaggctttgaccatttcaagcacgctgtagcctgtgcctgttccaaggttgtatgcatcggctcctgtagagttcaatactttttccagcgccttgacgtggccttctgcgagatcaacgacgtgaatataatcgcgtacgcctgtcccgtcttttgtcggatagtcatttccgaatacgtttaattgctcgagcttcccgactgctacctgtgccacatacggcataaggttattagggattccgttcgggtcttcaccgatccgtccgcttggatgcgcgccgaacgggttaaagtaacgaagcagcgcaacgctccactcattgtcggctgtatgcaaatcacgcaatatttgttcaagcatgagcttcgtctgcccataaggatttgtcgcgcctaatggaaagtcctccgtaatcggcgatgtttccggaacgccgtacactgtcgcagatgaactgaatacgattttcttgacgccgtatttctccatggcctcgcataaaataaacgttcctgtcagattgttatgataatatttgagcggaatcgccacagattcaccgactgcttttaacccagcaaaatgaatcacagcttcgatttcattttcagcaaaaacctcatctaccgcttcccggtccaataaatccgcttcgtagaacgttaaatcttttcccgtaatctccttgacacggttcagcgcttcagccgaactgttagacagattatcaagaacaacaatctcgtagccgctgttcaatagttcaacacatgtgtggctgccaatgtacccggcaccgccagtaacaagtattgccatgatgtaaaccctcctaaaaaatgacctgttatcattatatagtgtttagaaccggtccacatccatttttaagaagtttaatcgtttattaatagtttcttcatatattattagcattttcatacctttatgcagcgagcaagtatagcagctgaaaaatcaatctgccggttgacgtttttctttcctattttcgctatgcttaatgcagaaaggatttgatgacatggcgatgagcccttatatttttattgtattgattcttattattttatcgatgtatcgagagagagctgtcagacccgggaagttgctgatcattccgctgctgctcttatggggcgtatcagcatcgtttcagccggcgtattttcattccgtattacatgtggcgatcagcggcattttattactgatcgggctggcctgcgggtttggcattgggaagatggtaaatgtgcggattcacccggaaaccggaaaggtcacttcacgcggctcacttgggagtgttatcctcattctagtgatactttctttgcgcatggccgcgagaacatggctgcctgagagcaacgagatgtttattgccattattcattctatgttcttcgttcccctcggcaccatcacagcccgcaacatcatgctttacaaagcatacagacggctgaccgccggcaaagtatccattcaataaccgaaagaaggatcagcatgaacggacaaactccggctcggcactactacaagaagcttgtgccgagccttattctcattttgaattgcatacaatttttatctcatccaactaaggctgatcccattttgttagcatttgtatttgcggtatacttggcattcatttggatcattcccaatgtggcatccactgctgttagtttgagcatattcatcggactctggctcctgaccgatttcttttgggctgtttccggccaagagcagggtgccgcctattttttgattgtatttttaatgatatatgccgcctttagactcccttcacggctatccttgatcttcacagcatgtttaattggaggcaacatattactcctatcctcacaaggggaagcttgaataccatcatcagcaacatctcgatcatgatcggactctacgtcttcttctcctccatgcgtttcagacgagaagcgagaaaggaggctgaacggaatcatgctgaattggcaaaaatgcatgtgcagctggagcatgctcataaagaactccagaaagcgcatgcagagctgcaggaggcttctgttctttcattaaggtacgcggtccttgaggaacgtacaagaatcgcccgcgacattcatgacagcatcggtcacgagctgacttctgtgattgttcagcttcaatctcttccctatatactcaaaagcagcaaggaagattcagaaaaagtcattcaaaatgtactgagtgtcgccagggaatgtcttcaagaagtacggtctgtcgttcaccaaatgggccgtagtgaatcgatggtggggcttaccgctttgcgggggctcattcatcaagtggaggaacggagcggcttgtacgtttctttagatactgccggactgtcagaagagtcttggcctccaaacgtgagcgaaacgatctaccgcatcttgcaggaagcgctgaccaatatcattcgtcacgccgatgcttcccatgcggcggccgtcatttctaacgacaagtcccatctctatgtcacaatcaccgacgacggacaattcaccggcagccttacttatggatttggcctgacaggaatgaaagagcgcgcagaaaaagcaggcggttcccttactttcagtgccgtacagccgagcggcctgaaaattgagctgtcattgccgctcatgacaacgaataaggagcaaaaagatgaacaaagataaaatacgcgtcgcgcttgccgatgatcagccgcttgtgcgtgaaggcttccgctacgtcatcaacgcacagacggatatgacggtttctggcgaggccggcgacggtcacgatattatagcactcgcaaaacaaacaaaacccgatgtcatcctcatggatgtccagatgccgcattgctcaggcatcgaagcggcgaaagacattatgtccgcacttccaaatacaaagatagtcattttaaccacctttgacacggaagaatacgtatttgaaggcatccgtgcgggcgcagtcggctatctgctgaaggatacacttcctgaagagttgatagatgcgattcgcgctgcggccagaggcgaggctattttccgtacagtcacagctgctaaaattatcagtgagacatttcgggcgaagcaacagccccatccagaagaactggcagagccgttcaccaaaagagagcttgaggttcttcagcaaatggcctatggactgagaaatgaggatattgctgaaaagcttttcgtcagtgaaagcactgtgaaaacccacgtgcaccgcatcctgcaaaaatgcaatgcccaagaccggacacaggcagtcgtatttgccattcgaaacggtattgtgcaatagaaatctctcatcccgccatgctaaaataagacaaaggagatgattggaaatgaaagaagaaatcattgaacggtttactacatatgtaaaagtcgacacacagtccgatgaatccgttgacacttgtccttccacacccggccaattgacattaggaaacatgctcgttgatgaattgaagtccatcggcatgcaggatgcagccattgatgaaaacggctatgtcatggcaactcttccctccaatactgaaaaagacgtgccgacaatcggctttctcgctcacgtcgacaccgctacagactttaccggcaaaaacgtgaatccgcaaatcatcgaaagctatgatggaaaagacatcgttctcaacaaacagctgcaggtcaccctgtcacctgatcaattccctgagctgtccggctataagggccatacactcatcaccacagacggcaccacccttctcggcgcagacaataaggccggtatcgctgaaatcatgacagccatggattacctcatcaaacaccctgaaatcaagcacggcacaatcagagtcgcctttacgcctgatgaagaaatcggaagagggccgcacaaatttgatgtgaaacggttcaatgcatcctttgcctacacggttgacggcgggccgctcggcgagcttgaatacgaaagcttcaatgccgctgccgcaaaaattacgattaaaggcaacaacgtacatcccggaacagctaaagggaaaatgatcaactctgcgaaaatcgcgatgaagctgaacagcctgctgccggcagacgaagcgcctgaatatacggaaggctatgaaggcttctatcacctgctgtcgattcaaggagacgtagaggaaacaaagctccactacattattagagactttgacaaagagaatttccaaaacagaaaagaaacaatgaagcgtgccgttgaagaacttcaaaacgaatacgggcaagaccggattctgctggatatgaacgaccaatactacaacatgagagagaaaattgaacctgtcatcgaaatcgtcaacattgccaagcaagcaatggaaaacctcggcattgaaccgaagatttcccccatccgcggcggcaccgacggatcgcagctgtcctacatggggcttccgacgccaaacatctttacaggcggggaaaacttccacggcaaatttgaatacatctcagttgataatatggtcaaagccgtaaatgtcatcgttgagattgcaaagcagtttgaagcgcaagcctaatgccaaaagccagtccaaaaaaggactggcttttttgtgtgaaaatgaaacattttaaacgcgtcctccgtaaaacaagtatcaacaaatgaggaggaaaaacaatgacaaaacatgcaatcgctgcaaagagtctcttgaaaaaatggatcatttccaggccgcttaacatgcaaaagaaatccagcccatttcaaaaaatcagaaaaatgttcaaacgcttcttcaaataaaacattcaaatccccaagatacaatccgtattcacccgtaccgcccaaatgctccgaaatttgggttttttgtgttcaattccgcaaaatagggtataaaccaaacaagcaagaaaacagcacccaaaaacaggcaatttgaattacgaaaacttaggttaaaagttatataaaggaatttattttatcgtcgatagtaactatagaaccaatcatcaacaagagcaaacagcgtgattcaagactattttcaggtcatcaggttatactgttttagagggacagtttcttgttatttattgatttagaattttttgaatactttttggcattttatccgtacaatagagagtaccaaaactttttttgggaggtatgtaatatgatcctatttattatcatcgcattatgtggctatcttcttttttctttcagcaaggacaatcgccgcaaaccgcaaaagacaagccctctgccagcagccgcacctcatcacaacaacctaatcgaccttgacgccatccgccaaaaacgccggatgcatctttcctaattctatatttcaaacgaaaaggctgctgaatcacgcagccttttaaaattgttttgatttagagcctgaaaccttttcgtcacctatccgtaatttcatacaaggcaaacccaaaggagacttcagcaatgatcgagttatttatgaaacaaaaaatgttctcatttaaagatgcatttcacatttatgaccgggatgaacaagaaacattcaaggtggaggggcgttttttctcgttaggagactcattacaaatgacagactcatctgggaaaacgctcgtttccatagaacaaaaactaatgtctttattgccgcgctatgagatttcaattggcgggaaaacagtttgtgaggtaacgaagaaagtaacgtttttcaaaccgaaatttgtgatttccgggcttaactgggaaatcgatggtgatttatggagggatgaattccagctgacggacggggaaaatgtccggatgtcagtgagcaaaaagtggctaagctggggtgattcctatcacttggagattgcaaacgaggaagatgttctgatttgcactgccatcgctatcgtgcttgatatggttttatataacgatgaaaatgaaagtattctctaaaaaacattgacaattgatccaaaagtaataatattaagataattgaaatctgaatatgaagttttaccttatcaagagaggtggagggactggccctatgatacccggcaaccgctgtttcaaacagaatggtgctaaatccttaagaacattgcgttcttgcagatgaggcggagatttgatcgttcaagctcttccttcacaaaggaagagctttttacatgctcaatatttcagaaaagaggcgaataacatggctcaacaaacgaatgttgcaggacaaaaaacagaaaaacaacgcaaagcacctttccgcgccgatcatgtcggcagtttgcttcgttccgttccggtaaagcaagcccggcaaaaaaaagcggctggtgagatgacagcagaacagcttcgtgatatcgaaaatcaagagatcatccgcatcgtggaaaaacaaaaagaaatcggtctcgatgtggtaacagacggggaattccggcgttcttggtggcattatgacttcctggaagggcttgacggtgtggaaccgttcatcccggctgaggggattcagttccataacacaaaaacgaaagcgcgcagcatcaaagtgacgggaaaactcgattttacgagccacccagcgcttgctgattatcaatttttacatgagattgccggtaacgcgacgccaaaattgaccattcccagcccaaatatgctgttttttggcgaaaaggcggataaagggatttatgacgatcaagaggaatactttcatgatctggcccaagcgtacaaaaaagcaatcaaagccttctatgatgctggctgccgttatctccagcttgatgatacgtcatggtctctcttctttgaggaaaaaggcagagaggttgtccgggcgctcggcggtgatccagaaacattgccagccatatttgccaaaacaattaacgatgccgtcgcagaccggcctggcgatttaacgatcacaatgcacatttgccgcggcaacttccgctcaacctgggcggcatcaggagggtacgacgctgtagcggaaacgattttggacggcttaaaccttgacggcctgttcttggaatacgatgatgaccgctccggtaactttgatccgctccgttttgtgaagcgcaaggatctgcaaattgtgctcggcttgatcacatcgaaatacggcgagcttgaaaatcatgaggatgtgaaacgccgtattaatgaagccgcgcgttttgtcagcttggaccagctatgcctgagcccgcagtgcggtttcgcctctacagaagaaggcaaccttttgacagaggaacagcaatgggccaagcttcgccatgtcatcgacattgccaacgatgtgtggagataatctatcattgacagaaatagaaaatgtgtgaataatagatactatcagaaaatttcataaaaaggttttccttatcaagagaggtggagggactggccctgcgatacccggcaaccgctgtttaacagaatggtgctaaatcctttagagcaatgattgctcttgaagataaggttgagattgtcacgcaagctcttccttatccaaaggaagagcttttttacatttgaatggaaagaaggaatggacaacatgtcacaacaaacaacacccgcagaacaaaaatcacttcaaagaaaaaaaccgccgtttcgcgcggatcaagtcggaagcctgctaagatctgagcccgtcaaaaaagcgcggctgcaaaaagcggccggcgatatgaccgctgagcagcttcgccaaattgaaaacgatgaaatcatccgcattgtggaaaaacagaaggaaaccggcctgaacgtcgtgacagacggtgaatttcgcagagcatggtggcactttgatttcctggagaacctggatggcgttgagccgtttactcctgagcaaggcattcaattccataacgtacagacaaaagcacgcggcattaaagtcacaggcgatatcgacttttcaactcacccaatgcttgaagattattcatttctccatagcattgccggtgacgcgacgccaaagatgacgattccaagcccgaatatgctgtttttccgcggaaaactggaaaaggatgcgtataaaaaagattatcaccttttccagcatgatgtatccaaagcatataaaaaagcgattcaagcgttttatgacagaggctgccgctacctccagcttgatgatacagcgtgggccgttttcttatctgaaaaaggcttaaaacaaatcgaagcgttcggaacaacgcctgacgagcttcgccagctgtttgcgaaatcgattaacgacgcgattgcagaccgcccggatgacttgacggtaaccatgcatatttgccgcggcaacttccagtccacttggacagcggaaggcggatatgacgcagcagccgaaaccatttttgacggcttgaatcttgacggacttttcttagagtatgatgattcacgctcaggcggatttgagccgctccgttacgtaaaacggtctgatcttcagcttgttcttggcttagtgacatctaaattcggtgagcttgaaaatccggacgacgtgaaacgccgtatcgaagaagcgtcccgttatgtaagcttagaccagctttgcctcagccctcaatgcggatttgcttcaacagaggaaggcaacaagctgactgaagaacagcaatgggcgaagctccgccatgtggttgagatcgctaatgatgtttggaaataagaaaagaaaaaacacacttgattccctagcggagcaagtgtgttttttatgtcattgtgcggtgtagcccccatcaaggacgacagcctgcccagtgacgcccttcgccttctcgcttgccaaaaacacggcataatccgcaatttccttgacggaaagcagtcgcttttgcggcacaagcggaaaaatgacttgttcaagtacagagtcgtaagggacatttctagttttcgatagatcgctaagctgattgcgtacaagctgggtatcgacataacccggacagagcgcattgactgttatgccgtggggcgcgccttccagcgcccctacttttgtgagtccaatgacgccgtgcttggcgctattgtaagcggatttccctgcaaagccgactaatccattaacagacgcgatattaatgattctgccaaactgctgttttttcatgatcggaaaaacatgcttcattgcaataaagggcgccgtcagcatgaccttgatcagctgttcaaaggtgtctgtcggaaactcttcaatcggagcgacgtgctgaataccggcattgttcaccagaatatccaagcggccgtattgtttttggatgacgttcaccgtatcagcaacttgcgcttcctttgtcacatcatacggaatggccgccgcgtcaaagccttcttctgcaagcttggaggctgctttttcacatgcttccggacggaggtctgaaacgatgacgctggcaccttcccgggcgaattctcttgccatttcgaatccgattccgccggcagcccctgtcaccaaagcgacttgttttctcatgtcaaacaccttcccattaagaattgagtacagattggcttacagcgaaatcagcttctgttttttcataaacctcttcaattgtgacaccatcctgaagctccgtcagtgtcatgcggccattcacaaaatcaaatacagccaaatccgtaatcagcctgtgcacgactttctggcctgtcagcggaagagagcatgtttttttcacctttgattcgccatgcttattgacgtgctccatgatgacaacgatccgtttcgccccgttgacgagatccatggcgccgcccatcccttttaccattttgccggggatcatccaattggccaaatccccctgctccgaaacctccattccgccgagaatagccaaatcgatatgcccgcctcttatcatcgcgaatgactcagcgctgtcaaaataagaggcgcccgtcacttcagtgatcgtttcctttcccgcattgatcaaatccgcgtcttccattccttccagaggatagggccgattccgagcaagccgttttccgactgaagcatgacgtgaacgccatcgggtatctcatttgcgacaagcgtcggcattccaatcccgagattcacattcatgccgtccttgatttcttgtacagcccgtttgaccattcgttttctcgcttccttcacttggcctcaccctttcccgatgcttgctgaactgttcgtttttcaatccgtttttcttggctcgcgccaagcacgacatgctgtacgtaaattcccggcgtatggatgtgatctggatcgagctctcctgcttccacgatttcttccgcctcagcaatcgtgatcttgcctgccatggcggcaatgggattgaaatttctcgccgttttcctaaaaaccaaattgcccatggtgtccgctttccacgctttgacgatcgccacatcgccggtaatgcctcgctccagcacataagtccggccgccgaatgttttatgttcctttccctcggctatggaggtgccgacgcctgtcgccgtataaaatcccggtatgcctgcaccgcctgcacgaattctctcagcgagcgttccttggggaacaagctcgacctcaagctctccgcttaaaaactgccgctcaaaaattttattttcaccgacataggaagcgatcattttcttgatttgcttgttagccagaagcaaaccaagcccccagtcatcgactccgcagttattgctgacaacggttaaatcctttaccccctgatctcttatagacaaaatgagctgttcagggatgccgcacagcccaaaccctcccgcgatcagcgtatccccatcatgaatcaatttcgcagcttccttgcttgatgacagcacttttcccatattgatgcccctttcgttttcttctacactagaccagtcaggctgtaaatcgcgatcacagcaaatacggcagccgttttaatgagcgtgatcgcaaaaatatcgcgataggattgccggtgtgtcaaacccgtcacggctagaagcgtgataacggcgccattatgcggcagtgtatccatcccgcctgatgccattgaaatgacccgatgcatcacctctggcggaatattgtaagcctgaatcgcctgtaagtattgttctgacatcgcgcttaacgcaatgcccattcctcctgaagccgagccggtgattcccgccagcgcagttgtcgtaacggcgccatttacaagcagatcggtaaaagtatgtgaaattccgctgctcagcttatgaaaccccggcagcgcggcgataatgccgccgaacccgtactcggcacccgtattcatagatgccagcaaggcgccgccaatcccttcattcagcccttccttcaattgggcaaacacacttctccaatcaaataaaatcgttgtgatgatgccaatcactaaagcaatctccaccgaccaaatagcagccgctgaagaaatatcaagcctgccgaactcctttaatcctatggaagaaaaatcaaatccattcggataccactttggcaggtaaatggtaaaatatttattcactgcaccgacgagaataagcgggacaaaggcaagcgcgtgccgaatcgggcttttgtccggttcagccgcggactcaatcgattcaggagcaggagcattctgcgaatcaaaaccgccatagccttcgccagatgcctgcgcttttttccgccttgattccaaatagagcatcccagctgccagcacaatcactgcgcccatcaagcccagccaaggggcggcataaatgtctgttttgaaaaacgacgtcggaatgacattttggatttgcggcgttcccggaagtgcgtccatcgtaaacgtaaaagcccctaaagcaatcgttcccgggatgaggcgttttggtatgtttgcttcttggaacatgtttttcgcaaaaggatatacggcaaatacgacaacaaacaggctgacaccgctgtacgtcaagacagcacccatcagcacaatggcaagtatcgctctttttgccccgacaagccggacaattgttttcgcgattgatgccgcaagccctgccatttcaacgacctttccaaaaatggcaccgagcaaaaacactgggaaatacagcttaataaaacccgccatcttctccataaaaattgatgaaaaaaaaggaagcacatggcttggatctgtcagcagcaccgcgaataacgcgcaaatcggcgcaaacaatatgacagaaaatccccgatacgccgtaaacatcagcaaacctaacgccaatagaatgatgatcagttccacacacacatcccccgtttccgcgaactagaaagcgtttacataaacctgtccgcatcggctgtttccgtcccctttccatatgtacgagaagcgtgggccaactattccgattaaaaaaggaaagctccttttttcggagctttcctctgccattcatttcattcctattaggatatcaacatcaaccgtaatatcggctgatttcatctctttcaggaggctgactcgatctttcggcgccgaccaggcaagcggcgtcatcttgagaagccagtggatcgcctgctggtcaagcgttttaacatagcgcagcctgacaggacggctgtgtgctgcatttgctgcaaaacgctcaacagctgccgcattggaatacgtgcgtcttggtgaatcagcatataaaaattgtcttaattctattaaataatcgcttcgcggcactacttttacgagcatgccatcattcttcagcagtctatgaaactctgcataattggacggcgaaaaaatagacagcacaacatcaaattggcgatcatgaaaaggagcacgcgccacatcggcaaccgcccacatctgatctttgaatgccttagaagcttttaagatcccatccttcgaaagatctatgccggttcctatcgctgctttccctgcataatcaaacccgcaaagcgcattcaaatgagaaccctccccgcaaccgctgtccaggatggtgaatgcctcatgaccagatgtgggatgactgatgagttctgcaatcacatcatggagcgggtcaaaaaaaccacattctccaatcagcctgctcctcgcttcaaaaagctcggcaccgtaactggttttgaccggcttcgtcagaaagttcacgtagccgtgccgagatagatcaaatgtatgtcctcgttctgtacaaatcaagcttttccctgatgccgcatccatagaagaatcgcagagcgggcatcgaaacatgctgaaatcaactgttcgcttcatgataaaaaacaccccattcattcatttttagataaatgaaaaaggcatagacaaataaacctaggcctatctcaaaaattggccaggtctggcagtttgtctacacctgtcattatctataacgaatgaattggataatcatgaaaaaaactccctttctgctgtatgggtttccccgtttccatcatacagcaaatatccaggagctggaaccttatagtgaagaaaaatcagtactgacatgctggtatcccgccaacatcatatcagcatagcaatccagcatgtttttcctttattttctcattttagaatataaattttattattgtgaaaatagttaaaaaggttgattttcaaaaagtgaaaggataaaatactgctatcatcttagaaaaagacattcttgtatatgatcagtaatatggtctgattgtttctacctagtaaccgtaaaaaactagactacaagaaagtttgaataaatttgaacgagttgaaaaggacaagttcttttctgtttgctcttatttttcacactttctgcacttccagaatttgtgaaggataagagctttttttgtttccataataaccctcataggagttgctatcatgtactttttactaaaccttgtcggtctcattgtgattatggcagttgtattcctatgttctccgcagaaaaagaaaatcaagtggcgcccgatcattacgttaattgttctggaattgctgattacttggtttatgctgggaacaaaagtcggaagctgggccatcggtaaaatcggtgatttcttcacttggctgattgcttgcgccagtgacggtatcgcgtttgcctttccgtcagtgatggcgaatgaaacagtagactttttctttagtgcgcttcttccaattatctttatcgtcacattctttgatattttaacgtatttcggcattttgccttggctgattgataaaatcggatgggtgatttcaaaggcttcccgcttgccgaaattagaaagctttttctctattcaaatgatgtttcttggaaataccgaagcacttgcggttatccgccagcagctaacggttttaagcaacaaccgcctgctcacattcggcttaatgagcatgagcagcatcagcggctccattatcggatcttatctttcaatggtgcctgcgacatacgtgtttacagccattcctttgaactgcttaaacgcgctgattatcgcaaacctgctgaatcctgttcacgtgccggaggatgaagatatcatctatacaccgcctaaagaagagaagaaagactttttctctacgatttctaacagtatgcttgtcggcatgaacatggttatcgttattttggcaatggtgatcggatatgtcgcattaacgtcagcagttaatggcattcttggcgttttcgtacacggcctgaccatccagacgatttttgcttatctgttcagtccgttcgcattcctgcttggattgccgctgcacgatgcgatgtatgttgctcagctgatgggcatgaaattagcaacgaacgagtttgttgcgatgcttgacttgaaaaacaatctcaaatcccttccgcctcacaccgttgcggtggcgacgacattcctgacgtcctttgcaaacttcagtactgtcggcatgatttacggcacgtacaattcgatcctagacggagaaaagtcaacggtcatcgggagaaacgtgtggaaactgctcgtcagcggaattgcggtatctttattaagtgctgcgattgtcggcctgtttgtgtggtagaaacattgagccatatcccttttcggatatggctcttttcattattgataaatagaggctggcacctgcacatcccggattcccgctgcataaggccccaagtcatactggccaaagacgatggcgatcccgtttgccgtaaagtaaaacattgtgtctttgtttagggttatatcctctttcttaacatcagggaaaaacagctcatcgtgttttttgatatagctatataggtaatctctcgttttgctgacttttgttttggtgttcagaatctgatccagcgtcacccgcttttgtgttttcaagtcatagttgaaggactggacagacgttaaaccgtgggcgccgcctgaatagatataattgagtgtttgaatgctgagcttgcctgccgcattgtatttgacgctgaaggatgcttgatattccgttttaaagccctgctgttcgcctgcttttttgtttttcaggtattcctgatacgattgttcaatgtaggctttcagctcttgattgattttcttttcaaacgcggcattcccgatgtgatgcacttgtggatacgttaactccttgatctttttgtacgtatgggtgctgacagtcggtgttttcgcttgaactgcttttaaagatggggccgcatatgcaaatacggaaaaaagcaagactgcaatccccgcggctttcagcattttattccatttcatacaatctcctcctttgatgtcgttgtttatcattcccttatttaagcaatacacacttttatagactgattaaatcgaaagaagtttctaggtctaacagcatgatttttccaataaaaaaagagacacaggatgtctctttttttactgtttgcgcccagaaatcgcttcatgaacggcctgtgccaaatctgtatttccgaacatttctaataccgcaatgacagtctggtccggaatgtgctctgcttcgtgttttggcacgaccagatcgtccatggtttttttcaagctttcattcagcttttgctgcggatacgctttggcgtacagctccatcggatcaagatcatggttcacgcaccattgggcaaacaccaaaatcatcatattttcatcgcgttcgtaagcttcagcgagctgtttttcgttcatttgtcatgctccttatgaaaagtatcttccttaaagatacaggagccgatcaaattcgtctatcccaatggcgatgagcagaaaccgcatcgataaatgccttgctgaaagcggtgtagtcaggttcatctttagccgttacgatgcctggcccctctgttgtcccgacagaggattgaagaaggtcaattccttcatttgccgcaccgatcgccttgtagtgattgtaagcttctctgataaactccatcgcttgtttgttgtcttttaactccggccctcctgcggcatagacggcatcatacagaacagaatcaaccgtcaggaacgtgccgctggcctcaagctgctgtccgctgccgcttgtcatataccccagattttgactgatgatatccactgtgattccttcttgctttaaggcttccagtactgtttgcagctctttttcatgaaatccgtttccggcgagtacagcgacttttcttgttgacgcgtttttcactgtacgggcttggcttaacgcaggcgaagtaagaatttctttagatgctttacgcttcgcgggcgccgccacgcctactcctttggcgatttcttctgctaaatctgcatcgacattgctgaagacatcaacgacctgccgctgtacgtctttgcttttgaccttcccgacctcgaagcagaaagcagaaatgatgtgctgtttctccacaggagacatgctgttccagaaaagcttcgcctgtgagtaataatcgttgaagctgtcgcttcgctggcggatttttttgccctcgactttttcctgatagtggacgtagccgccttcttcagctgtcgcaggcgacggatcattgttttgcagtgagtttttatgataagcgacaggtcccttattgatcgtcatccggtgatagccgtcatattgattgttatggaatggacataccggccggttaatcggaagctcatggaagttcggaccgccaagacgaatcagctgtgtatccgtataagagaaaagtcgcccctgcaatagcgggtcatttgtaaaatcgatgcccggcacgacatttcccgggtggaatgcgacttgttctgtttccgcaaacacattatcctggttgcggttcagcgtcattttcccaataatcttcaccggcacaagctcttccggccacagcttagtcggatcaagaatatcaaaatcaaacttgaattcatcttcctcatcaatcatctgcacgccgagctcgtattcaaccttgccgccgttttcaattgtttcccacaggtcacggcgatggaaatccggatctttcccggcaattttctgcgcttcatcccatacgagagaatgcacgccgagcaccggcttccagtgaaatttcacgaaacgtgcctttccttgttcattgacaaaacggaacgtgtgaacgccgaagccttccatcattctgtagctgcgcgggatgcctctgtctgacatcgtccacatcaccatgtgagccgactcagggttattggcgacaaaatcccaaaacgtatcgtgagcagtcgctgcctgaggcatttcattgtgaggttcaggcttaaaagcatgaaccaaatccggaaatttgattgcgtcttgaatgaaaaacaccggaatgttatttcccacaaggtcatagtttccttcttcagtataaaattttgtcgcaaagcctctggcatcccgcaccgtgtctgcggagcctttagaacccgcaaccgtagaaaaacggacaaataccggtgtcttcaccgaagggtcctgaagaaatttggcccgtgtgtattccgtcattggttcgtaaacctgaaaaaagccatgcacgccaaatccgcgtgcatgcacaacgcgctccggaatcctctcatggtcaaagtgcgtcattttctcccggaaatgaaaatcctccatcagcgtcgggccgcgaaccccggcttttaacgagtgctcatcctctgacactcgcaagccttggtttgtcgtcattttcttcccgctgttatcggtcctgtactgctcaagctgctcgtcctttgagtgttcatttacacgtttgttttggtcatcactcatgtctgctccccctttttaaaacgaaacattctacagcacatttacccgtggcgttcttcatataaactgctaatccgctcattaggatttttggtctacatataaatatgcggtcatacacatttgaaataagccttcttcacagaaagaaaggatggaagcgcttactaaaaaagctgttgaataggggaggtcatatcatgcttgccatactcggttttgtgatgatgattgtctttatgtaccttattatgtctaaccggctttccgctcttattgctttgattgtcgttcctattgtgtttgccctgatcagcggatttggcaaagatctcggcgagatgatgattcagggcgttacagacctcgcccctaccggtatcatgctgttattcgccatcctgtatttcggcattatgattgactcaggtctgtttgatcctctcattgccaaaatcttatcgtttgtcaaaggagatccgttaaaaatcgccgtaggcacagcggttctgacaatgaccatttcgctggacggagatgggacaacaacctatatgattaccattgcagcgatgctgcctctttacaaacggctcggcatgaaccgtttggtgttagcgggaatagcgatgctcggttcgggggttatgaatattatcccgtggggcgggccgactgcgagggttttggcttccttaaaattggacacgtcagaggtctttacgcccctgattcctgctatgatcgccggcattctctgggtgatcgccgttgcttatatcctcggaaagaaagagcggaagcggctcggcgtcatttcgattgatcacgcaccgtcttccgatccggaggccgcgccgctcaagcgtcccgctcttcaatggtttaacctgctgctgactgtcgctctgatggccgcactgatcaccagcctgctgccgctccctgttctttttatgactgcgttcgccgtcgccttgatggtcaactatccaaatgtcaaagagcagcagaaacgaatctcggcgcatgcgggtaatgcgttaaacgttgtctcaatggtgttcgcggcagggatattcacaggcattctctccggcacaaaaatggtggatgccatggcgcattctctcgtttcactcatccctgatgccatgggcccgcacctgccgttgatcactgcgatcgtcagcatgcccttcacctttttcatgtcgaatgacgccttttacttcggtgtccttcccatcatcgccgaagccgcttccgcttacggaatagacgccgctgaaatcgggagggcctccttgctggggcagcctgtgcatctgctcagcccacttgtgccttccacctatctattggtaggaatggcaggcgtcagctttggcgaccatcaaaaattcactattaaatgggccgtgggaacaacgattgtgatgaccattgcggcgcttttgattgggattatttctttctaaatgtatgagcttgatcgtagcattgagtacagaggggagaagatcaaataggatattatgagtgaatagaagattcatgccaacaactcctcattacaatcataagagcctgctatattgcagcaggctctttcacatttggcattatttttttgtatagcgcacccagtcataatgagcgtatagcggatttacaccattgtaggagccaagccattcatcgacacccgtgccattccacaagttcatcatgatctttccaggtgttgtcggaatttggtttgttgcagtatgttttaattgcccgtcgacataccatttaatagagtttggctgccaatcgaatgcatacgtatgataggcattggctgcatcaaacccgagatcaacaatcttctcatggtttcctgcaccatttgtataatagttaaattgaaccttcgttgtgtcttttcctaaaaattcgatatcaatctcatcccaaggagttccatctgttggacctgtgtaagtgaagaacgatgaaacgatccctgtgtttttagctggtttcattctgacttcataaagtccatagccatatgtttgaacagaacggttttccccgcagtcaaacttgttataagctgggcttgttagcgctaaacgcatttcacccaatgacgtcattgatacgttattagcccgccacgtgcagttgaacatatttccattcgaataaccatctgctttttgccaaaaaccggagttatagccgttaaaagggtcaaaaaacgatccacctgtttgagccgaggcagtagaagtgactgcaaacaaactcataaacaatccagtgacaagaagcagcaacactcgtttcagataaggcatattggcattcccctttcattgaaagcgttttctatgttgatcttacatgattcttttaaagggaacatcggtcaaaataatgataataccgaatcttacttacttgaatcctgtaactatcatcatcttccctctgaaaaaaataaaaacctaaattaccatcagcacagacagagatgatccgcactcattgtaatttaggttttgcctgctttatcagtaacaatcctaacattatcatatggaaatgtaagaaaaaaacgaacacacgaaaataaaaatgtcagcgctctcattatgcttgtttaactaccctttctatgtgaatggttaaatacagcagctcgtcacttgtgagcttgtgctcatactcccgctcaatgtaggtttggattttcttcgtgcattcatacgcgcgatgatacttttctttcactgtatccagcaaaaaatcgtcctggctttccatgtgagtgccgttaaaaagacgctgcgcgaaaaactttaagtgggtgacgaaccgataatagtgaagcgattcttcgttgaattcaatcttaaaatggtattttacaatactcaaaatctcttgcatgacttttgtaatgttgataatattgggcatctcttcattcagctcggcatttacaatatgcagagcaataaagcccgcttcatcctctggcagagacacaccagtcttgtttttcaccatgaccaacgcttctttgccgatcgcaaattcgtctttgtacagccgttttgtttcccacagcaaggcgtttttgatatcaagccctttctggttgcgctggatggcaaagttaatatggtcggtcagcgacacatagatgctgtcgttgagctttttgccgagctgtaattttgcgtagctgataatctcttcggatacttccatacactcgatcggtatatcatacaaaagggttttgaacttttctgatacatccttgttatcgagcgtgaacactttctcaatgcgggcttcatcgacatcatcgccggactttttctgaaacgcgagccccctgcccatgacgaccaattctttcccttgttcattgaccacgctgatcacattattgttgatcaccttcgcaattttcatgacatgtccctccaatcaactaagaacagactatatcttgattgtacattctttttgtactaggtcaatatcatcagggaaagacggaagctggtcagtacaattcactccgtacctgctgcccgggctgtttttgaagcagcgcctccagatggcgttcaaatgatgccttgtcagctttctgctttttgacaatgctgttcatgattttgacgctttcggcgctgtattgtgtatattgttttttcagctgatccagctgctgtcttgtcttcttcgcgtttttcggtgtgacttggccgatgagtttgatcatattgtctgcgttctcaaaaaaagcggctctattttctgtcagctgctgaatttcgatgcggctcatgtcttgattacgcgttttttgaagcaaggcgaccgcctcgctgttttgttttttgagcgatttgttctcaagcttaatcgattcgagattctccttcgcaatgtctgcttcttcttcagtcatgctgcttcgcacgaagtattctggattgccgattccataatcaaatgcttcgctcacttgtatcatggaactgaacacaatggccagctgcctgtcgcttgcgaaggcttggaaatcctgctttttcttgctgctcatcggtttggctgcggtttgttttactgtcttttgatcacagtctgcgaatatctgagcctcaccttcactttcgcatgcgctcatcacaagaactgtgaccagcaggcttatacacaagcctattcgcctcatgctctgtctcctctctgctgaatcccttctggaaaataccataaaatatagttaaatggtaccagatgcacctaaccccagcaataaatcaaaagtatgatttgaagcgaaaaaacataaatattttgtaaaaattgacgtgcattccattcttttcaggcccatttttcgtacaatagaagtatcgttaccggagaggggctctgatgatgaaacgttttacgaaacaagaaaacagctgggtattatatgactgggcaaattctgcttactcaattgtcgtgaccaccgcggtatttccgttattttataaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagccggtgtcgccagcaccgcgatgctcgcctttatccctagtgaacattggctgctattgttgctgttttatacgatatcggctatcggtttttccggcgccaatgtgttttatgatgcctttctcgttgacgtcacgcctgagaagcggatgaatctcgtctcagcacggggttttggcttaggatacattggaagcacgattccatttatcatcagtattgctgtcatcctgctcgcacaagcagagactattccagtgtctgtaccggccgcaagccagctgtcctttttcataacagctgcctggtggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattatatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattcttcggtttttacaacattttcggaaaattcgcctcaattatggggccgctgctcattgccgtgaccgcccagctgaccgggaaatcctcgactgcggtgttcagtctgatcattctgtttgtaattggtattgtgattcttgcctttgttccggaggagaccagcgccaatgtcagccagcagcaaaatgacctgcccctttaactgggagcaggtcattcatcatttattcgctttattcaccttcagcattttccctttgacggttgtgttcttcatcactttgagaacatgagggcctttaccatttaaaatctcaacgtatgaggcattatccatgatcgtaatgatgccgatgtcgtcagctgacacaccgtcaatttttgcaatcgttcctacaaaatcaacggctctgattttctttttctttccgccgttaaaatacagcttcataatgtctttattcagctcttcgcttttgtcttttttgctttccggacggtcattcattttagctagaaattctggtttcttccttgccacttcctcttgagaaggggcttctattttttgaatctcaaatccgatatattcttcaatgtcggctaaaaaccgtttttcgaaggccgtgacaaacgaaatggcctttcctttgttccctgcgcgtcccgttcggcccgtgcggtggacatagctttccttttcaagcggcagatcatagttgatgacaagggagatattttcaatatcaatcccgcgcgcggcgacatccgtcgcgactaagtaacggtactcgccacgtttaaattcattcatgacgtcgaatcggtcttcctgaatcattccgccgtgaattttatcgcatggatatcctaagtcatccaattcatcggtcagctgattgacgtgctccttcgttcggcagaaaatgatgcagctgtcgggattctccgtcatcagcacatctttcagcaatgaaaatttatgctcttctcttacttgaatcaccgcatgttcaatatttcttgtggtaagcccggccgctttgatttcgatatgctcggggttttgcatatattgacggctcagcttctcgatatcctgcggaagcgtcgccgaaaacagcatcgtcgtacgctcagtcggaagatgcttgataatcgcctccacctgctcaatgaagcccatattcagcatctcatccgcttcatcaatgaccaaataagagagacgatccaacggcagcgtgcctttttcgatatgatccagaacacgtcccggcgtaccgacaacaatgtggcttttttgcttaagctcagctttttgtttatcaaaggaggattttccaaatactgctgtcgctttgatccgtttaaatcgtccgatgttcgtgatatcttcctttacttgcaccgcaagctcacgggttggagttaaaataagcgcctgcggcttgttttcatcccaatccgccagctcacagagaggaattccgaacgaagccgttttcccgcttcccgtctgtgatttgacgacaagatcctttcgttcaagggcagcggggatcacgctctgctgcaccttggtcggttctgtatatcccagtccttccaatgctcgtaaaatgtcatgactgatttgatagtttttaaaatgactcatgtataaactcctgtctcttgcagatgttctcattatactctaattgacgaaggcatatgtgttttgtcgaaaaatgatgtattaaaagccatcgattccctggcgttttagctcctgaacagccaatcgcgccagtgcgtcagcccccgcgcggttcggatgcagcgtatctccatccatataaagcccgagtgttctttccggaccgatcgatgtaaagtatgcagagctgaggacatttaagtcaatgagatgtgttttttcctcttcggccaaagccaaaatagaggccctgtaccatctgtttacagacgaatggatgccttcagaagtaaaatcggttgcccggccctgaggcgttgataggatgacgtccgctcctttcgctttcacctggcggatcatatcacgcatcatctctttaaactccgcttcagattcattatgcttcggatttgtgtcattaatgccgagctgcaagataaaataatcccccggcttgatgtacttcaggatcgcctcaagctgtccatcatttctgaaccctctcgcgatctgtccgccagacgccatgtttctcacttgaaaggtatgtttatcgatatagtgaggcagcatctgcccccagcccgcctgcttgctgctgttgagcggataataattgcacaccgtcgagtcgccgccgacataaatggttcgattcgtcaccggctgatcagacaatttctttattttcaaggcgctgagcgtaaaagcggtgccagctttcccctctgtcaccagcagattcagctgcccgtcggtgacaggaatttggaacgtatcctccgcgccatcccctgtcatattaatgacctgaaacacaccctccgccgtaacactggcccttgccgtattaccaagcgtcaccttcacctcataaagaccattcgggagatccacattaaacgtgttattgcttttcgtcccatacgctaaaaactgaaccgcatcccttttcacaccagtcccggatgccgccacatccctcatattctccggtgtttgaaaaccgtagccctttgaccggtcataccgatcagacgccctgacaccaatataatcaggctccactgaaccgcttccaaagtcaaactgatacaccttcggctccgctgccttcacactctcattcccgccaaaacacagcatcagcatcatcacaaaaaccgctgccatccattttttcatcaagactccccctctatgaaaacgcatacattaatgcatactcggtgattgtttctttatgatgactgaatgaagaaaaaaattgcgttgacaaacaaaaaggaagattttattatatcaatagatgatatatcatttgttgatataggaaatgaggtgaacacttgccaaagcaacgtccgcaggaaatggatcagcttaccgatccagcctattatattgtcttaacattgctggagccaaaacacggatattcgatcatgcaggagattgaggacatgaccgatgactccttcacgatcggcccggctaccttatatacattgttaaagaaattactgcaagaagagatcattgagctagtcaacaatgacaatccgcgccgcaaagtgtaccaaactaccttgcacggccaagaactactcaaaaaagaaattcagcgcagaaaagtgatggctgaacacggcgaacgcgcttttcagcaattgaaaggggattcatcatgaaacagaaaaaatatatgatgtccgaaggcttggctttttcagaagaaaaagatatgaagaaactcagtgatatggccagcaaaggctggttgctcgattcatttgcggttatggggtataagcttagaaaagctgagccgcagaaattgatctacagtattgattatcatgatattgaggaagaaagtttggcggaatacactgagatgtttgaagcggccggatgggagcgtgtttgctcttcacaaggtatgcatatcttttcggctgagcccgggacttcaccgatatacagtgatcaatctaccatgagagagaaatataaaagaagcgaaaaagacgttcgaaacgtcacctgcaccttgagtttcctgactctcttgtccattacactccattatgtaaccggattatcaaattgggtgcctttgttttttctgattgtgactatcccgtttctcgtgacatatgcggcaacaaaagcaagaacgcttggaaagtggggaaaatcagtgtgacttcttgtcacacttgattagatcccaccctccgcaatagaaactcatctggccttcttgatcatacacataataacggagtctttcccattgatcgtcagtcggttcaatctccaactcaaccgcatcgatggattcaaggtcatccagctttgatgcactaatgttttcaaaccgcaaatgaatgtcacaggtttgagctgatagttttaattcaaacacaggaatatgaatataacgatcatcttctttcatatagaaagaaaactcgtttaatgtaaatggaccgtatccgcatcagaaagatgttttttcattttctcgtattgtgtgatattcaaatgaattcctcctattcttagttactgccaaccatatagatgtctacagcatcgtattcaaaccacatgatccgttcgcctgagtccgttaggcactggagcttcccttctgaaaaatagtttttatccggttgaggatcagtgatcagaaaaacatcatcattgatggaagctaacagaaatagaaaacctgcaatatcccggtctgcttcatgtactacgcattggaaatgaaattgccttttcgccagcttcgtcaccttgtaagcatgaccttcaaaatactcggacaggtcttctataaatgaaccagtcgttattacctgtatcatgattcgatcgtaggcaagcccttcccaaaaacgataaaatgactctgcatcttcaagttcgcatgacataacggtttggtcaggcttaagctcgatcatgtccaaattgccaatactgcttatagaggttatttccataaaatcttccccttatcagttggatagcgcaacgcaaatctcttgtctgacttgttcatacaatattatgtgacaatacaaatcggtatcgtttttaatcatagccgtcgagatttcaggatacagctcaaaaaagcttttctccaacgaacgccgctgatgcctgggcatccttttattcgccagcacataatccaaactgccagcaacaagcataaaaaactcatagatttcttcttcaaagccgtacaattcatcaggatacggcgtttcttcaagctctcgctgtctttttttcagcttttgaagcacgttgatcctctccctccacaacaaactcatttatcttgaaataggataggcggatcattatctatcgcttccaacagctcttcaccaaacacagtgattgtcaatttccacgggtctcccaagagtccccaagagaagtcctgatgaaaaaagaaataatagtctccatttggaaatacgggaacaggccattctccaaattcatcctgaggcattgtctgatgagggctaaagatatatccgtcatgctgccagtctaatgcgtacatcacatcgtgttttccactacatgattgaaatgcttttaaaatcgaagtctctaaatcattcagcactctgaccacatcatcattactggctttaccgctcatcccgctagaaatgtcaaacacttgatatggatcaggcgggatgatgtgatgacatctgcttccgggtttccattttatgatcttgttcacttctgaccagatgcggtcttgttttgtctgacttaaagcgcgccaattcatcataatctcatccctacaccttattggatatcctgcttataaacaccagatgaggtcactgcgtaaacagcgttacttgtcagtttcagctgttgaacatctagggctgcaccattcgaatcacagcatgttatctcttccatctcttgactcacatcggcagaaatcaaataaagagacgacttaaggtctgcactgtaacaattgaacgtcccaaccaaaaaaccttcttcggatatcgcgagctgatcaaatgcttctgagtccggctctttatccgacagaatccacactcgtctcacgaccgtttcatcaaatgcggcaatgactgcgtctccgtaatacagcatataaatcaagccgtttttttctgcaagtccataacaatcatctacagccggcgcatccatttcttcgagctttctatcaatgtgtatttccttctgctgaccatccaaagtaaaacaccacacactatggccgtcaggattttcatcatcataaatgccttcatcatttaaaccgacccaaaggttttgtttctcatccaaaagacagcaggaaacccctgaaggcaagtgaaaagcacttttcacccttccctcttctgaaaaaacctttaccttcggctcatacgattcgtaataaacgaagacatagccatctgcacattgttggaagagctgaatatcgctatatgcaatctgctctttcactttaaaaacccgaatatcaccggaaggatcatagattgagatggtcacatcacctttcacaccttttccaatgtagacacgccccagtggatcagcatggaaaaaacaatcttgggtgtccatgttgataattttattcatttttaattttttcatttgttatgctcccagtttagaaatgaagtgataattaagcatttattagctattagtaacggacagcctagtttcattaatcgttttgatataaagctactttccaattcagtcttaaatcatttagtgtttaattggtatgcataaaacgattgatcatcaaagcgaactgtttcagcttctatagcaatcagcattctgttcatgtcaataagaaagttagcatttgattgatactccggaattatagaatttgatagattcccgattccttctggatgataactcatctcaaatacttgccaattgtattcttccggatctattttttccaatctcatgtcgccaacatctgcactataataagcggatgccacattttgaaataatattttatgggtatattcagcttcactttcaaaaacctttatattaagtgagagctcttttttaaacacattaaaatctaaataaaggacactgcacccctcatcaatgtaatcaacccattcactaattgttttgtacattgtcatctcctgcctcttttttaatcaataacaccttaccaccaaacacaaattactccatatattgtttgatccaatcattcaaatcatctgttgaatgtaaataagtttcaggagaatctttcaaatcaatcccacttagaaggattaacatactccagactctatcatcttctacttcggggtcatccgcatgaacataagttccagcccaatccgacacttcttctcttgttgtttgtccatttaagacacttttgattttatttatgcattctattagctttggctcgctcaatttgatcaccacgtattcaagtactaaatgatttgttattagtatgcaaagcaccgtactgatatttagatattgaagctttttccgtaaaagatatgttccaaaaggtttccaatctaccaataaacaagctcacatccgtattccgtgtgcaatatacataaaccaaactggcacttaggctcaaccaaaataaaactatgattgagaatcccttcatcgaactcaatacactccaataagcagtcaaggtgctcgagacattttccaaaagaacaaactaacgcaccaatttcgctgctgtattgatgaaacagcagaacgtcccggtcatcgtaagcaacatatgactgagatattttccagatcagctgtttcgcttcctttttttcgagggcatcaacctcacgggtgttggctggtattgaatttgataaaaccagctcaagcaattgcctgctttgcgccagatcagcaaaacgataagtgaagcctctttctgcacaagggactagtttttctttgatttcgctcatcaataaacgtcttttattctcggcgagtttttcgatcaatcttttttgcatgagccgcattccctccgctgtcaatttctcaacttcttttaaattgattcatcattctcttgttttcgttgtcgttcatgtttagatttgttctaaaaaagcttgtatcgcttatcgatacaagctttatcttcaactgcttaaaactcacccagtgggcttttcacaaaacgctgggaacctttttggcaaatcctcttcatcccaatcaattctatatttttagattcttttgtcatacaaataagagaggatggtaacatctcttatttaatgttccatcaataaatgccccatttttatccaatgcagaaattatttataattaaggaagtttagaaggattttttgtattttcaagatttaattttaaagcggtcacaaaagactctagcttttcttcattacaattaatttcgaacaagttggagttcgacttactttctttataatcatcaaatataattttaatcttaattctgtaatttccgttttcttgatcaatactaagaaataagaatggttcaatagtctctaaactgatactgtcttgatttccttttatcatagtttcgatcccagatatcaacaccttatattcactttctaataaaacagcagaaaaatcgcgaacgacggctttcttattttccaacaattcaaatacagataaaataaatggatcatcgtccaactcttgataccttctcggtgttaattcaagttctatacaatcatcttttattttggccatatttcctcctcatttaaagtttaagtgagggtagttgtcatcccccctcgcttaaccttattaacgccttctcttagatttatttccttttccgtgtgtatggaatacgtgtttagaacccttagctcttgaacttccataagctgtgattactttaccccttttatttaaaacaactgtagctttttttccaacatatttcgttgccccattaggttgttttattacttttttagggcttcgcacagcattcagtttggcccttaaattgactccacggcctccatttcttcctatagattgattaagtccatgtcttgtatgacctgtgattttaactgccttcttcgtaaacttataggcgcgactagcacccttaaatatcttcccaggaccaaaattagaagcagctgcccaagcagcacctttccatcctttacctgatttatatgccttatatccatcataggctgcaaatccggcatttaccacaagccatacccaatgcccatccgggtcaaccttcatcaccggattgttattggcataagtatacccattctgatccaatgaatcaccgtcacttcccgggtctgggtcgagcgataggaacacgccgtttcttggctcgtagtagcgggccatgagatagtacaggccggtttcttcgtcgtattggtagcctgcgtagcggtagcgattgtcttttacttcgtcgcttgcttcggtttttgttggatttccccatgcgtcgtattgatacttggcaacggtttttccagtgctgtctgagatcgcgatgacgtcgccgtgtgcgttgtagtgatagaaatatttcttgccattttctgtgtaggataacagctggccgctgtccccgtacgtgtacgattttgtgacgttgttgtccgcgtctgtttcatacaagacgttcaagctatctccgtcgtagaagtagttcgtgacttttccgttgacggttttttggattctgtttcctttttcgtcatacttatatgttgcgaatggcttgtcttcgccttttttggtaacggcggtcaggttatcttctgcatcccacgtatatgtgaatttgccgtcggatgtgcggttgccgtttttatcgtaagagatgctttcatcattgacttttgtcagctggttcatgatgttgaaggaagcgttcaccgttttgcttgagccgtcttttacagttgtaacggttttccggttcccgaatccatcatatgtgtattcaataacagtaccgtcttcatgggtttctttgacaagctgattcagcttcccatactcatattgcaccttgccacttgctgaactgtttatagtggtacggtttccgttggcatcatattcatagctttccgtcagaatgtttccgccgtttttgtcaccgatatgcagcgagcttacaaggtttctttcgtcatatgaaaaacttgttccaccgccgttgcccgtaataaaggtttggacgttgccattttcatcataatcaaatgaataggaagatgtactgtctttcatctcaatcatttgatccagcttgttatacgtaaattgattcgttcctttttggtccccatgagtccacgagaaggttttcagcttatcggagtcactagggtatgtccaagtttgactgccgccgcggtcagtcaattcggttaaacgatttttattgtcaaatgtccgtttctttgtggtgttctgctctttattaacgaccgacgtttcatttccatttttgtcatacgtgaaattgtacttttctgtaccgttatacgactttgatttcacccggtctgttccatcataagaaagagatacttcgttgccattcggtgaaatggttttggtcagattgctgttggcatcatattcgcttgctagcacattgcccagagggtcagttgttttgacaagcttgcccatcacatcatattcgtatttataggtttgatctgctcccgcccggatggttttgcttacctcattgccttccttatcatagctgtgaaggatagaagtgccgttggagagcgtcatgtttgtcagttggtctgcctgatcatacgtataggatgttttttcaccttttgcatccgtttcagacgttttcttaccagtttcatcgtaatcagttgaagtagagtatcctagttcatcttcttccttggtcacatagttaccattactgtcatacgtgctttttgtcagaaggcttccttcaatcaaacggatatcatcaaaccacgcggttcctgttgcgctcttttggaacagtatgctgatatcgactttattgatcggctttgtttttggtataacaacagctgcgcggttccattcctgtgttccagaagggaatttcgcattgtatacgcctgtgctgccgtccgcgtaagtgacattagcctgcagagaatagtctttttcatctgtgaacttgacactgcttgctttcgacatgcctgtcagtgtgagataaaccggtttgtcatttgcgctttgccctaagacaacggtttgttttgatactgatccggcttgggacgcactggtccgggcaacttttaatgatacttcatcattaaagccttcttcaaaatcaacggatgccccgcttacattccagttttccgttgctgatgtgaagctactgttttgaactgggttatagctcgatgatacttcgcctttttccagctggacttcatcgaaccttgcttttcctttaccatctttatctttatgatcgacttccatatacacaacagcttttcctgcattcgctggagtcgtaaaagtgatttgccgttttgtccagtcattttttccggctaatgcactgtattcattgtgaatccactgaattcgtttttgatctttgtctcgcaaatcaatgttaaagtaggctcttgatttcactagatctgttttgattttcccgcttaatgtataggttgtattcggctccagctcaactgtttgtgttgctgacgaatacccatgatctgttccggcagaagttgattggctcaagacttccaatgcctttgatccggaaagaaccccgcttttatcggtgataattgagattttgccgctgtctttagaagcagtcagattccagccggatttttgtgcttcaaagcttccatctttcaaaatattagttgaagctgataaatctttgctggattgaatctgatttccgtatttatcataaacggctgctgacgatgattttccactctgatcggtttcggatacagcatccagtccgtcataagcaatatccgtgacattgccctcggtatccttcatttttgtgacatcgttgtttttgttatattcgtatgtctcagttccatatgcgtctttaaccgacgtaacgttgccatctttgtcatattgatagctttccgttgcttttccggtgccgacgtcgtttggatcgacatcttctacgacattgttgccttcatattttgtattcgttgtaatttttagcccttcagcatcatcaatgacctgaatcggatttcccgcctcattatagccatactgtaccttccggccatttggctgtgtcatgagaagtgtctttttatcagcatcatagctgtagacatatgtttcttttttagcgttgatcgctttttcgagacggtgtccgctatactgatattcggtaaagacaggctttgcttcggtactgttggctgaatactgtttgacaaggcgcccttcactatcgtagtcatagcttgtgacaatcccgtctgtatctgtaaccttcttcagcaaatcattctcatatgagtaggtgactttcttatttttaggtcctgtgatggacgtcacatggccgttttcatcataggtaaatgtaagcttgcggcctgatgcatctgtaatggcggtcagttgatttttgtcattgtaagtatagacagttgcattgttatggccatccactaccttttggagtttgccgccttttttattgaaataagcattggtttgatcttttgtttttaatatgaactgatcagcagtttctgttaattcaagatatacaccggtcggcggctgaaacgtgccatcggcttttttcgtgaatcgatgtgtcgtagcgtcttcatcgatatacattgccccgccatccgttgagatgacagatgtttctgcatcagcataccagccttgtccaaataagtgatcagagctgtcaagactgttgtaggttctcgataagccaagtcccggaccgcgtccgtcaattgacaaatcttcttcattcacaatgacattgcctgtcgcaccatttaactggccgcttgggatatcaatgatagaccagtattcttctgtcccaaggaattctgctccttcatggaacgttgggttaaagggcgccgttggaattgtttcaccattcgcatcataagcgacaagcgtgaaagaataattcttcttccctttgtaattcccatttgcattgttatagacaggtgatggatcgagggctaattccccgccttttccatctgtatgaagcttatagcttccagctttgatttcctcagaagtcggccagatgtttttattttgggttgtccaatgatccgcgtcacccacatcaaaggattgatattctttaccgttgtaaatgttaactttatagcctttcgcattttgaaccttttcccatatcaaattcacatagcccgtttgactcgattttgtatttgtatacaaatagccagttaaattctttggcttagcgatatcaggaagtgccgggttagcagccggtgatgcaatggattcgccgtctttgttgtatgcgataattttaaacgagtaatttcttttggctccatctccccggcgtttttataagttgggccgggattgatcggcagctctgcaccattgccgtctttcagatgaagagcatatttcccagccttaatttcagcacttgtcggccaaatctttttccctttggtggtccaagacgtctgatttcccagatcaagtgtctcaaagcctttcccattgaacacctgaatcttatagccggttgcaccagatacagctttccaagaaagatcgaaataacctgtggcattcccattattgtagccctttgctgatggtgcttgtgcttttcctacattagggataacgggctttgccggtgcggacatcgctccttcaccttggtcaaatactgcactgacgccaatccagtagtttttgcttgtagcatagcttccgccggaattcttatagaccggggatggatctaatgccaattcagctccacccttgccgtccagatgcagtttatatctcttggaggcaatttctgcgctcgtaggccagatttttttcccttttgtgctccacgacgtgacgttgcctgcagaaatcgcttgatattccttaccattgtagatccataccttatatccttttgcgccttcaacctttttccagctgatatcgaaataacctgtggaatcgccgttgtgataagctttaattgtaggggtgtttccctttggtatggtatacgtcacttcaatatacggtttattggcggagttcgctgaagaaattagttttttccaatactccttgccgtttccgtttgtatgaagcttaaatccatagttggccccgccagagttccatgactttacagcagcagtcacgtcataactcgcccattgtcctttatggacgtcggcttttccgatatttttagatgccggtttggtgttccatgtcacttttgcattatcataattgctgtttaccgtatccagccaaagaccggttgcctttgttccataataggaatgggctacgtatgtttttaatgtagctttagtgacagtcatattttgaattggctttaggttgttaaatttcatgaacgcatagtttgtgcctgttgttttgtcataatagcccgttttcagtacataggcctttaaattagcatcccatttttgtgaggaggccgaatagttcgtcgtcgggtaggcactcatgacaaacgtgtccgatgaaacagataaagaagttgacgggtcgatagatactggatatacgcgttctgggtctttcagccagttctcgtctgccgtaagatgaagcaaatacccttcttcattcttttccagcttatagctgactttgtctgaccgttcaacctcgccggaaagctcatctagttttgaatccgtcataaaaggcttaggcacagaaaaaacaacttttcctttttcatcagaaaaatcaatggatccatcctcttgctctttagcctgcaaatcggtttttaactgaaatgtaaatgtgttgtatccattatactgatgaaggactaaatcttcttttatgttttcattgaatgtgaaagtctgaagatcaatattcggaaacacatccggatacacaatctcattactgtcagtcttataatctgctgaggtatctttcggagtaagtgaagttttattcgggcctttcgcttctacaagtgaatatgtaaccttatggtcattatgctcaaaagtcgcataaagcccgttcttcatttgcttttgaaaatctgaattcaaaatagcgttctctgtctcgacttgtttgcttgtcgactcttttaactcaggagaaatgtcttcccagtcggcatcaggtgtttcctttgtatgaataggatcaagatatacttcctgtttatagacaccgtcaccttcataatagagttttgtattttctgttctttcagaggtgatctcaccctctttgtttatatcttttggatcaaaaggtacagcttcctcagtttgttctttctgaagagtttcttctggatcatcggcagcaatacgatttccattctcttcttctgtggtttttgccagtacatctgctggcactaatgaaatgattaaagccaacactaaaaatgctgctatgaaccttttaaagtttcgcctctttctttttttcattttctctctccttttgtaataaaagtaatatttactcaataatcttaactagactgaaatattattacaatatttttctagaaaatttatcttattttaaggattagcgagagtcaattgacctaaaacaaaaaaaggccgcataggcctttttacattttccattattgcatttgttcaatatccgtaccctcagctgccacattcgccttcccctgcctcctgacaagcgtcaaggccatgcccgcaaagatcagcacgatgccaagcgtttgatagaggtcagggcggaagcctgtgaagacggtatcgagcacgatcgcgacagcggggtcgagaaatacaatgattgaaataaatttcgttgataaaaatcgcaaactgtcaaaaaacaacaaatatacaatacccgtatggatgatgccggtagataccaccataatccagtttccctgagataggtcagcaaaagcgccaaagtgaataaacggaatcaggatgataacccctaaacccgtctgcaagaaggtggtcgtgtaaggactgagattgtgaatgccttttcccaataaagtggtgaacgcataaaacagtgcggcgagaactgcccatatgatccctgatcccatcacctgtgtcaatgaagtgctgccgttaatcccggaaatcagcgcagttcccagaaagcagatgataatggagctgacggagatcacatttaatttctctctgtagaagaagctccccagaagaagaacaagcaccggcgctagatgataaacggagatggcaattgtaacggacgtttcttcaaaagacttaaataaaaacacccagttgaatacaagaaagaaaccgcacgccaatgtttgcagcacgtctctcttgctccatttttcagttttatactggccggacgccagccagcaaaggcctaaaaacagcgtcgcgcaaaggcagcggacaaagaccaattcaaatgacggcagattggtatgctctgagaaaaagccgatggagccgaaaatcaccatagagatgaccattttgattacggctgttgatttttgttttgacgatatggaaagatcctgttgcatcaaacgtattctacctccaatactgcatagcataaactgttttttgtgaattcagaaatctacacatagaattcctcttttttacatgtagatattataacacttctattctaaataaaaaaaagcgcccaagggcgctttttttacaaatctatcgaacaatcaaaaccgggcatgttgataattgagacactttatggctgacgcttccaagcatcatttctttcagaccgctgatccccggctgccaactacaatcaggctgacgcctttctcttttgcgtgatttagtatctcatacgccggctcgccattcgcgtaaatggtttcagcttgaacgcctttttcggctgctttttcttttgcattctcaaggattttcaggccctcttttttaacctcgttcctgatttcatcaataaagtgttcaggcacatagacaattcccgtcagagaagaagtcgtgacgacggcttctctccccacatgaagaatgcttagttccgcttgttgctcttttgccaaatgcactgcggcatcaagcgcttttgcactcatgtctgatccgtcaatcgctactaacattttgttaaacatgctcttcccgcctttcggactgtgggtggttcatctttctcttttattgtccgcctgcattttgttattgtcaattgaagcgtatgagttttcaaaaatttgtcagatactctctccgtttgtggcgatgacctgcttataccagttgaagctttttttcttgatacgattaaatgttccatttccttcattgtcccggtccacataaatgaagccgtagcgttttttcatttccgcagtagatgcgctgacaaggtcaattggcccccatgatgtgtatccgattaattcaacgccgtccgcaatggcttcgcgcgcttcaattaaatgatcacgcagatagttgattctgtaatcgtcctgaatcgtgccgtcctcttcaaccttgtctacagcgccaaggccgttttcaacgatgaacagcggcttctggtaacggtcgtataaggtgttgagcgtgatgcgcaagcctttcggatcaatctgccagccccattctgatgatttgaggtaagggtttttgactccgcccagcaggttgccccctgattttgcaagctcttccggatctgtgcttgccgccatcgacatgtagtagctaaatccaatataatccaccgtatgttctttcaagagctcttcatcgccttcagccatttcaatttcaatattgttttctgccagatagcgtttcatatatcccgggtatgcgcctcttgcctgaacatctgagaagaaaagtgttttgcgctcattctccattgccgcgaagacatcctccggcttagaagtcatcggataggttgtcgttgccgctatcatacagccgattttcgaatcaggaatgatgtcgtgacccgctttgacagcaagagcactggccacaaattggtggtgtgccgcctggtacatcgcgtttaatttgttttctccttcttcaaaaacaagaccgccccggtaaatggcgcatggagcaccacgttaatttcattaaacgtcatccaatacttcactttgtgttgatagcgtttgaaaaccgttttggcatagcgttcataaaactctatgactttacgattcttccagccgccataatttttcactaaaccgagcggcatttcataatgagagatggttacgacaggctcaatatgatgctttaacagctcatcaaacagatcatcataaaagctgaggccttcttcattaggcttctcttcatcgccattcggaaaaattctcgtccacgcaatcgatgtgcggaacgccttaaatcccatttctgcaaataaggcgatatcctctttataacaatgataaaagtcaatcccgttgtgatacagattcaaggaagtcattgattcatcaaatggagacatgatcccgttcggcgatacgtcagctgtcgaaagccccttaccaccctcgttataagcaccctccacttggttggcagcaactgcgccgccccataaaaatccttctggaaatcgttttgcgtttgaactcatattgatcaccccattagttttttcaagataaagcaagcagcgcttcttttgtctgcactttaccgatctcttttaccggcgaaaatgaatattggtctgtgttggtcacgatcaccggggtaatgacgtcatatcccgcggctttgatttgctccagatcaaaggacacgagcggatctcccggtgcgaccttgtcgccttctttgacgtgagccgtgaaccattgcccctccagcttcactgtgtccaatccaatgtgtatgagtatttcagctccctgatcactcgtaatgccaattgcgtgttttgttttaaaaacggtggtaacgcttccacgaacaggcgaaacaacttctccttcttcaggctcaatggcaaatccttttcccatgatcccggcagaaaacactccgtctttgacttcgcttaatgctttcacttctcccttaatcgggctgtgaatgatctctctgctgcccggctgctggctgccgtcagaaggcacatcctcgaatccaagcaaatacgcagctgctgttcccgccgcaaacgcaatcacaaggccgatcatcgcgtaaataaacgttgggccgataaagacagggatgctcggcagacctgcattcccccgacgatataggaagcaacacccgtcatgccgtaaaacgcgccaccggctgcaccgccaatcaaagcggccgcaaacggctttttcaatcgcatattcacgccgtacatcgcaggttctgtgatccccatcagcgccgtgatgcttgtggtaagcgcgagtgatttaaattttttgtttctggagcgaaggaagacggcaaatgatgctcccgcctgccccatattcgccaaaaacatagccggcagtaaataatcgtggccgttttgagcgatgttgttgatcatgatcggcacaaaggcatagtgcatgcccgtcataatgattaaagagaatgtacccgccagcaaaatcatcgccacaagccctgcatgatcaaacaaataattgaccccagaagacaagtattctcctaaaatagcaccaagcggaccgactgtaatcaatgtcagcggcacgacaatcaataatgtcaacgtcggaaccacaatcaatttgagagatgcgtgtgtaaaacggtcaatccatttttctacgtacgaagcaatccaaatcgccagcaaaattgggatgaccgttgacgaataagtggcagcggttacaggaagcccgataaaggaaatcggtttccccgcaccgagcagggctgtcaaatccggatgcagaatcgccgccgcaatggctgccgctacgtacggattgcttccgaattttctcgccgcactcatcgctagcaggagcggcaggaagtagaacgcgccgtcaccgacagccgtcaaaatgacatgaacctggctcttctccgccatccagccaaacgtaactgccagcgcaacaagccctttgatcatccccgctcccgcaatcgcaggcagaatcggggtaaacacaccagaaatcacatcaaagaccgcactcagcacattctttttctgagaggatgaaccagcgctcttttcatcactgagattgctgtgccgcacaatcgcctgatacaccttcggcacatcgtttccgataatgatttgaaactgctcgccgctgatattggtgcccatcactccaggcagctgctccaactgactgcgatccgccttcgaattgtcatgaagattaaaacgcagcctcgtcatgcagtggatcacgcgctgaacgttgtcttcaccgcctacgagttgtaatatgtccttcgataatttatcataatccatgtgtatacctcctttttatgggggactgctggaagaaaggtggccgcctttcaccagctttttttctatcaaatgctgcatcacctcctaaaagagaataaaaaaaacctaaatgacacagattgcgagagtctcctcctgcacctgcaccatttaggttttgcctgctttcacagtaacaatcctgacgggtcgctgtatttgtttgtaggtatactttagcactagatttgcgggatgtcaacgctttcatttttggtgttgactaaagggaatacttattgaggactgttttgttatagagggaagccattttgtatattttgttttatttttccgaaaatactatcaaatatatcagctgacttaatataaaagtaaaaaaccttgaaaggctatttagctcatcaaggtatatgttttatttttgactatcccttttccatatactttctccgtcagttaaaaaaactgcacttggcggatcatcataaagtgaaatttcaactaatgaacctttcttttgtattaaccaattatataaactactttcttcactagtaggatgagctaaaatatcatttacttgaaatgtaactgcataatattcgataaaattcacatcatcgtcatccaacccattgtctgtttcaaagagtgtgtctggttcaccaataatctttaatccactatcccactctattatcaagtcactatctttatactcttttaacgcttttattaaaggatcatattccatgtatatcctcctcttattacttctttaatggttctgaaggcactatatgcgctccgtcttttccgtaatgaatcattcctctagtagtttcaatgtattcaccagtatcacgatcatagtattttccaattggtttaccaaagtctactctttcttttttaccgtttggtagtagttgaccttttcctgcaaacttatcaagcaattcctgtgctgttttattatcaccatagaaaatactcttgtttttaccatttgctatttcttgtttgtaatttggcgtattaggaatatgtttctcttgagcacctggctttactttaactgggaatccatgtacttctctgtaaggtcctttaggtactgacttctttccataagaaggtacaccattacccgtatccttagcaacgtttttaacttccgcagccttcttagcctttttcccatcattaataagtttattaatatctattaacttttctaacttagctattttggcaaatggtactgagtttatggaggcaacaacacggtctttccctgtgactttttcgcctgataccggatctctgcccgtggctgccttaaaaagatcatacacgccggtaagttctacagctgtctctaaaattttcacatatccattctcatccactttaatgtccgaaagcgagacgacaggttcaagcttcatgtcattaccagatatgtatacattgtaaagtgtatcattataaacgacttgcttaacctctgcatttgagaaatcagtttttatatgttctctatgttcactcgtattatacactttaccattgataacgatgatatttttacttacctttttagaatcacccgttttgacaactgaatccactttagacttttcattctcggctaatttcttcaacatcatctccatcggagaatcatccgcctgctgcttcatttgcgggttaatggcgccgaaagtttggttgatgttttcttcctcctgcgatttcaagatggagccgcttttgtagcctgtgatttcaattttcggaccggtgtacatggtttcgagctggtctatatattttttcatcgtttgaaaatctgattttgcggtttctagtgcttgggtttgctggccgtcaaattgaaagagcttattcagggtgtctgaaatcagtcgctcagcctgttctgtttccattcggaaaaaggtatcattgactgccggtaagctgacgatgtggccgatggctgatgtctggcgattgactgcgtcagtgagctgctctgtcacttctcgtgcatgcttgaccccatgtcttgcatcgtgtgagagaaaagcctctgcgatcatgccgtgggagtcagattctacagaggaaatcgcatgctgtgtttgtttcagcacttttttgtattcgtcgataaacatgccaaagaaaaggagaaaaggcttgtggcactcctcgtaaaaggtccggatggcatctccgccttttcctttcagcgcatccttcatgcctgccagatgctcaacgcttttttccagcttctccagctgttgtttttgcttgtccagtttctcaatcgtatgctgaatgccctcgtgaagagcgtggacatctaatgttttcaatcccttgtcctcccggctttatttcatggaagatgatatgttttcgtccgtttccttcatggcgtttaccgcgctttccgtttgtgcgatatgcttggccagaacagacgcatatgcttcagtgagctctttgatgtccttatttaattgctcgatggacttcacaacattcaaatggtttctgcctgagagatggccgggcaaggaggacttgagttcagctgaattcttgagctgagaaagcccttgcttcactgtgccatacaccattttaatttcctgtgccatttgtgctcacctcactttttatgtttttccttctctatttcatgctctatcctcgtaatttggcgtcttatggaatacacatcgctctctaatgagtggattttgccttgaatgctttcgatgattccgctgacttgatcgcttttgatttgctgatatgctttgttcattccttcacgaatatcttcaaaccgctgagcatgtgttcctctccatgcctcccggttaagatgaggccggtgaatgagatgctgggcctcggagaattcgtgtttgatttgcctgatttcgtgcagcactcgttttaactgatggatctgttcctgtttttcatgtaagtcggcttttaccgaatgtaacaacatttcactatgcatgccgtaacacctcgtgtttctatcaaactgtgtcaattctttacaatacagactattttcatattacatgatgggtcatattggataaataggcaaaaggatttgtcttacacagaatataaataagtatatttatctattatccttttcattcgactttcttgcgaataaaatcctgcttacacaggactttaagatcgggtacaatcgtcctcatttgattcgcgatgccatttacaaatatctgttacctatagtcaataataatgataaaattaggatatctatctaaatatggagagagaaaaatgaaaaaaaacagtggttttcatgaagaattgcaagaaaagcacaagctttatccagtagaacatcattttcagcctgttttaccgaaagaatatacagaaattttaactttacatatagcaaaacaatttggcgaaaaaatcaaaacgcttgttcatcacggacaatataatcaggcggttgaattaacccaaaaaatatcttctgatcttggtaatgatactacctttgcaataccactttcttcagttctttatcatgtaggtgacctggatcttcctgtgtcagagcacttttcgctatcacggttgaatctactcggaaactatagagcggatgataatttttttaaagcattaaagaatgaaatgttaactgctgatcgtgtggattttatggtcagttttacaagatggtctggcgtccaacttcttattccaccattacaagagcttaataagcgtaatgtgccagtacgtattatcacatcaacatatatgggaattactgaacctaaagcccttaaacagctcatgaaatttcaaaatgtcgacttgagaattgtaaatgattacagtcaatcgtttcatacaaaagcttacttatttgaacgtctttcagggcaacatagtgtcattattggatcatcaaatctctcgcaatccgctctgaccactgggtatgagctaaatgcaagaataccagatacaaaatatcttccaatttttcaacaaacaaaagatgtctttaataaagtatgggtcgaaaaaacacaaccggtcgatgaccagttcttaaaagcttatgaagaatttcaagcagctaatcacaaaatgagcgcgtctctcgtctctcaaaactctctttaccaaacaaaaatacaacctaatgccatgcaagaaatagcgcttaaaaacctcaagaaaacgagagaacaaggtgaggaaagggctgttattatcgctgcaactggtacagggaaaacatatcttgcagcatttgatttttccgaatatcaaccaaaaaaatatctttttattgctcatcgtgaggagttactaactaaagccattgaaacatttgaaaaagtcacaaatgaccatgataactttggattgttaactggatcgaaaaaagaatggaataaaaggtttttatttagcacagttcaaaccttgtataaagaagaaacattaaaacggtttgcaccagatgaatttgattacattgccattgatgaatttcatcatgcagaagcctctacctatcaatcagtgttgaattactttaaacctggattcttattaggtttaactgcaactccagaacgtttagacggtaaagatgtacttgaaatctgcaatcataatgttgtctatgaaatccgccttcgagatgcgttagaagctgaattgcttgccccatttcattattttggtattccggaccatactgttgattacgataaagtgaaaataacaaacggggtctacgatgaacgttcattggttaatcatttgaaaaatcatgagcgggtcgattatgtaataaagatgataaatatgtacggtttcgacggagaaagaatgtgtggattgggcttctgtactaacgttgaacatgcccaatatatgagccaagaatttaatcaattaggattccatacaacttatttaacagggcaagattcctcagcacaacgtcagaaagtgattagagaacttgaagatccgcatcatagtttagaactgatttttacagtagatatttttaatgaaggcattgatataccaaaattaaacttactgctttttttgagaccgactgaatcaccaaccatatttattcaacagttaggaagaggattaagaaagactgatgataaagagtttgtaacggtacttgattttataggaaactatcaaaaatcgtttgttataccgctagccctttccggacaaactagccaaaaatcctttgataaagattcattacgagttgcggttacccatgagtttgcagacttaccaggtggatcttatgtagatcttgcatctgtaacgaagaaagagattttacacaaaattgatagtattaaattaaattcagctgccatgctaaaaacattatattatcaatttaaacgagatattgggcgttctccagagctacttgattttctttattcagatcaagctccaggtcttaccttttttataaaaaaatataagtcttgggtcgaaacaaaaagaaaaatggatgaccttcattctttagataaagaagtattaaatgattcgttagttttaagaatggtatcctggttagagcaacagtttccgattaagtggccctatgatttattattgttacaatgtggatttaatatacagagaatcactgtagaggatgttaaaaagtctttagaagatacatttcatttaaaaatcaaaaatactaatatacacgacaacttgattaaacgatctatggagcgtttatccacaccacataagaaacaacaatggagttttggtacagtggaggaaaatacgctcatactacaattaaatatttttgaacgtttatgccatcctcggtttggtccttatattaaggagcgtatccagtatggtttaaccgaatttagacgcatgaataatttagaagcacttttatctagtgaactacaactcaccttgtatcaaacatatactagaaatgaactcatacatttatttcaatcaactgatcaagagggaacgtggcgagaaggtgtaaggagagttaacaataactacttaatttttattacattaaataaatctaaaaaagttgaggaccatttgttatataaagattactttatagatccccatcattttcattggcaaagtcaaaatcaaacatcacatgcttctactgtaggtcagaattttattaaccatagacaaagagaatataaaatacatctattcgtacgtaaatttaacgaaatgcatgatatcaccttaccttttatttatctaggtaaagtagattacgtatcaagcaatggggacaaacctatgaatgtaatatggaagctccatcagtctgtcccagaaaacttgtatgttgatttaataaattaaagaagcaattgttggcaagatgcttatttaagtagctttgttacatttacaactcttttttggatctttaaagtttttataatcatctttcacgcttttaagaagtctatctaatgccgtaaaaacagttaatattaagaaactaaagtaatcaatagatttgttttggccttctaaattcagtagaattttaaaatcttcgtaacttttattaatagttataattaataatataatataaatcataattcttcgcacatcttgtttagcactgttgaaagtagaaaaatatacccaactagctaaaccaaatggtaaggacatccaaaaaacatagcgaatggtattaggtatatccgtaaataaagatgagaaactatataaaataaatacaataagtagatgtatataaaaacttaaccaactttcaactaatactttcattcgcgtgtagatataactttctttatctattttctttattaaagtttctattgggctaacatatttatagctgcttttatctaactgtttctttatatttaaattgaagttaccaataaaaattgtataaaagataacaatagcagctgatattaaaaaaatatataaatatttagaagtgttgaattttataatccacataagagttgttattaagaaaatgaatgtaagtattataaaaataatctcactaaccttcaaaaatctaatatatttcttatttggattataacctgtagaaacaattaatttatatttcctaaacaaatagttactaataagctcaatgaaaaagaatgttttatttataatatacttagaaagtaaaattattagagcaatgaccaaaattactatgaagaaagttataatcattgacaattaacaggtcccctttgtttcatttttcaataaattaacagttggaatatcagcaggtgcccattcaagtgactcaagttcactcacgggcacccatctgagttccgaatgttctttggcaaaaggttcaccctcaataattttcgcttgaatagaaatcaaatttataatgattttctcatattcgtgatgaatgtcagcgataatttcaccgacttcaattttacaaccaagctcctcatgaatttccctcacaagagcttcttgtgcattctctccctcttcaagtttccctcctgggaactcccatagattagccaaagacatggttggcgaacgaagtgcacataatatcatattcttatcgttttgaattactgctgcagcaactttgattgtttttttcaatagatttctccctttctgataaatatttttctcgcctcatattaatactatggattctaaagtaaagaagcaatgaaaaaacgccttccctcgaaggcgcttctccatcttatttagatccccaaacagcctcaccgctgccattcaacacactaaacgtcatgacgttcttctctctcaccgaatcccactggcgtaaaaataccccgttatactttttgcccgctaacgtgatgtcggctgtgttttttccggttttcttccatgttccggtcatttccccgaaatggtgtggtttttgttgagctggatgttgatggtttttttgatgtcggctgagatgtcttttccgtgctggatgagtttgtatgttcctgtgatatctttttgttttacttctttcagtgtttcgcccgcataacgatagggcgttgctaccggccagccgtctttgttcatgaacaattggtggactctgacttcgtgttcttcacccctgcccgggaagcgggtgtggaagattaaataggaacgcccggttttttcatcatagtatgcggagttgtggcctggtgagacgtacccggtgcctttttcattttctgtttcaaaagtgtagctgcccatgagtttgacgccgtatggttcgatggaacggtcgtcgaagaatgtgccttctttgccgcggacgtcgagcattcgattgccttctgcatcatagtaagggccgtctggtttcttggagcgggccacacggatgttatagccgcctgttgcatcgagaccgccatatgataggtataagtagtagtattgggtgtctggattatagagaacatacgggccttcgattctgctgtggttgccgccgagcagtttttttccgtatccctgcccaggaagcgggaagcccgtttttggattcatttcaagaatgaaaatgccgcctgagtatgatccgtacaccatccacagtttgccgtctttatcaaagaaggtatgcgggtcgacaacattcgggtgtttggttgcgtcatacggtgttccatcgctgcttgtgccttccattcctgatttcaaaaagatgcctttgtttttgtatgggccttcgatgttgtcagcaacggcaacacccatggcggatcttggcgagtcgccgcggcaagcgttgtagtacatgtagtatttgccgtccgccagctgcgtgacgtcagccgcccaaagagtatcggattgcgcccattcgaaggtttcttttaattcttcatagacattcggaataagtgggttgtcattgcttacgctggtggtcagctgatgccattgcatgaggtcatttgtttttgctgaagcgagatgagatccaaaaacataaaaagtgccatttgtttcaatgatggaagggtcatggacgctgacttctttaaatacaggtttttgtgcattggcggagtttgggagggtgaaggccatgataagagctgcaagaaaacatacacgaaacaatcggttgaacatctaaacaattcgcctctcttttttattaaattttaaacgcttacatttctctatgaagataccccggcctattaaaacagccgaatgttttcatattcaaacagataggtgatttctcactgttctcttacattgtcagactgatgtctgtctgttttgcgcggaactgctgcttgcatatcctctccttcatagttcaactcttttgctgtttctccttcttgcatcacgtctgtttttctttcgcgtacatgtaataactgctttgtcaggttttgcatcaactgtgatacagccatttcgttgtcggcgttttttaagatgatgcctgattgcccgtcaacaccagagtcattcggctggctctttataaaacgccttgcgaaaaatacgacttagtaaacgcatattgagagttagacagcggctgcttgcctcctgtctggatatcgtgtgcaatcgctgaaaaaacctgttctgctttctgcgtcacgctattacaatagcaatctaacttgttaaagactgtaaaaaaccttttgacttctgctgctgaaccaattaatataatactcagttaatagttatcagaatttttaggaattgagtgattcatatgacactgcataaagagcgtcggatcggacggctgtctgttctcctgctgctgaatgaggcggaagagagtacgcaggttgaggagctggagcgagacggatggaaggtctgtcttggcaaggtaggatcaatggacgcgcataaagtagtagccgcaattgaaaccgcttccaaaaagagcggtgtcattcaatctgagggttatcgggagtcacatgcgctttatcatgcgacgatggaggctttgcatggcgtgaccagaggtgaaatgctgctaggatcgctgcttcggacggtgggcttgaggtttgccgttttgaggggaaatccttatgaaagtgaagcggaaggcgattggattgctgtctcgctttacggaacaatcggggcgccgattaaaggtcttgagcacgagacattcggtgttggaattaatcacatatgaaacagcccatagatcttagacgatagggggctatgcgtggaaacagaagttcacagcatagctcctttttgtatgggcgctttaccaaagtaaagaaaaaggagttgggcttatggtgactttagacggttcttcattgacaacagccgacgtcgctcgtgtgctgtttgattttgaggaggcagcggcttctgaggaaagtatggagcgcgtgaaaaaaagcagagcggcagtggaacggattgtacgcgacgaaaagacaatctacggcatcaacaccggatttggcaaattcagcgatgtcctgattcagaaagaagactcggcggcgctgcagttgaatttaatcctttctcatgcctgcggagtcggcgacccttttcctgagtgtgtgtccagggcaatgctgcttttgcgcgccaatgcgctgttaaaaggcttttccggtgtccgcgctgagctgatcgaacagttgcttgcttttttaaataaacgcgtccatcctgtcatcccccagcagggatcacttggcgcaagcggagatctggcgccgctttcccacctggcgcttgcgctgatcggacaaggagaagtcttttttgagggggaaagaatgccggcaatgacaggcttgaaaaaagcaggtattcagccggtaacgctgacatccaaggaagggcttgccttgattaacgggactcaggccatgactgcaatgggagtggtcgcctacattgaagctgagaaactagcctatcaaacagaacgcattgccagcttaacgattgagggtttgcggggaattatcgatgcatttgacgaggatattcactcagcacgcggctatcaggagcagatcgatgtcgcagaacgaattcgcttttatctatctgacagcggcctgacaacctcccagggagaactgcgggttcaggatgcctattcattgcgctgtattccgcaagtacacggtgcgacttggcagacactaggctatgtcaaagaaaaattagagattgaaatgaacgcagctacagacaatccactcattttcaatgacggtgacaaagtgatttccggcggaaactttcacggacagccgatcgcctttgccatggattttctgaaaatcgcaatatcagagcttgcgaatatcgcagagcgcaggatcgaacgacttgtgaatccgcagctgaatgacctgccgccgttcctgagccctcatcccggtctgcaatccggtgcaatgatcatgcagtacgccgcggcctcactcgtttctgaaaataaaacactggcccatcctgcaagtgtggattccattccgtcatccgccaaccaagaggaccatgtcagcatgggaaccatcgccgctcggcatgcttatcaggtgatcgcaaatacaaggagagtcattgcgatcgaagcgatttgcgcattacaggctgttgaatacagaggcatagaacatgcagcgtcctatacgaaacagctttttcaggaaatgagaaaagtcgtgccgtccattcagcaagaccgtgttttttcctatgacattgaacgcttgactgactggctgaagaaggaatctttaatacctgatcatcagaataaagaactaagggggatgaacatatgactgatgtaaaaaaatcaatccgtgccaacagaggaacagagcttgaatgcttaggatgggagcaagaggcagtgcttcggatgcttcgaaacaaccttgatccagaagtcgccgagaagccggaggacctcatcgtatatggcgggatcggcaaagccgcacgggattgggacgcttttcacgccattgagcattccttgaaaacattaaaaaatgatgaaacattgctcgtgcaatccggtaagcctgttggcatgttccgtacacacccgcaggccccgcgcgtgctcctggcaaattctgttcttgttccgaagtgggcagactgggagcatttccacgaacttgagaaaaaagggttaatgatgtacggacagatgacggctggcagctggatttacattggctcacaaggcatattgcaaggaacctatgaaaccttcgctgagctggcgcgacagcactttgggggcagcttaaaaggaacgttgacgctgacagcgggtctcggcggaatgggaggcgcacagccgctgtctgtcacgatgaatgaaggcgtcgtcattgctgtcgaggttgacgagaaacgcatcgacaagcggatggaaacaaaatactgcgatcgaaaaacagcatcgattgaggaagccttagcttgggctgaagaggcaaagctggcaggaaaacctttgtccattgcgcttctcggaaacgcggctgaggtgcatcacacacttttgaaccgaggcgtcaaaattgatattgtgacagatcagacatctgcccatgaccctttaatcggttatgttcccgaaggctactcccttgatgaagctgaccgtttgcgtcaagacaatccagatctttacgtgcgccttgcgaagcaaagcatgaaaaaacatgtcgaagccatgctggcctttcagcaaaagggctctattgtatttgactacggcaacaatatccggcaagtcgcaaaggatgaagggctggagaatgccttcgattttccggggtttgtccctgcctacatccgccccttattctgtgaaggaaaagggccgttccgctgggcggcgctttccggagatccggcagatatttaccgtacggatgcgttattaaaagagctgttcccgacaaataaagcccttcaccgctggattgatatggcacaggaaaaagtcaccttccaaggcttgccgtcccgtatttgctggcttggatatggagaacgaaaaaagatgggcctcgccattaacgagctggttagaaccggggagctaaaagcgcctgtcgttattgggagagatcatttggactgcgggtctgtcgcctctccaaaccgggagacagaagcgatgaaagacggaagtgacgctgttggtgattgggctgtgctaaatgcgcttgtcaacacggcggcgggtgcaagctgggtttccttccaccatggcggcggcgtcggaatgggctattccctgcatgccggcatggttgcagtggccgatggaagtgagctggctgacgagcggctcgcgcgggtcttaacgagcgacccaggaatgggcattatccgtcatgcggatgcgggttatgaacgtgccgttgaagtagcgaaggaacaggacattatcgtgccgatgcaaaaataaaggagtgatgacatgccaaagcaaattgatacgattctcatcaacatcggtcagcttttgacgatggaaagcagcggtccgcgggcaggcaaaagcatgcaggatcttcatgtgatcgaagacgctgttgtcggcatccatgaacagaaaattgtgttcgccggacaaaaaggggctgaagccggttacgaggcagacgaaatcattgactgttcgggacgccttgtaacgcctggcctcgttgatccgcacacccatcttgtatttggcggatctcgtgaaaaggagatgaaccttaagcttcagggcatttcatatttggatattctggcgcagggcggcgggattctgtctacagtcaaggataccagggcggcttcagaagaagagctgctgcaaaaagcccattttcatctgcaaaaaatgctgtcctacggcacaaccacagcagaagtgaaaagcggctacggcttggaaaaagagacagagctcaaacagttgcgtgtcgcaaaaaaactgcatgaaagccagcctgttgaccttgtttccacatttatgggagcccatgcgattcctcccgaatatcaaaacgatccagatgaatttctggatcaaatgctttcccttttgccggaaatcaaagagcaggagctcgccagctttgctgatatttttacagaaacaggcgtttttacagtcagccaatcccgccgttatttacaaaaagtagctgaggcgggcttcggattaaaaatacacgcagatgaaatcgatccgcttggaggtgctgaattagcaggtgagctaaaggccgtctcagccgaccatttggtaggtgcatcggacgaaggcataaagaaattggctgaggcaggaacgatcgccgtcctcttgccgggcacgacattttatcttggcaaaagcacatacgccagggcaagagctatgattgatgaaggggtatgtgtcagcttggcaacggattttaaccctggcagctcgccgactgaaaatatccagctgatcatgtcgattgccgcgcttcatctgaagatgactgcagaagaaatatggcacgcggtcacagtcaatgccgcatatgccataggaaaaggagaagaagccggtcagctcaaagctggccgctcagctgatcttgtcatttggcaagccccgaactatatgtatattccgtatcactacggggtcaatcatgtacatcaagtcatgaaaaatggaacaattgttgtcaacagggagggagccattcttggataagtacccttttctcagagaggccggatcttcgtttaaagaccgggatgtcacaaaaatgagcgacctgatcgcaacatgggacggccaggacattaagggaccggcgttgataggtgtccccctatcaaaatcctccatcagtcattcaggcgcttcctttgcacccggaacaatacgccaggctctgaaacattcatcagcctattctgctgagcttggagagcacgtcgtatcagagcttctatatgacctgggggatatcgatattcatgtcactgatatcgtaaagtcacatcatcacattttccaaaccatgcacgctctgctttcggatcatccggattgggtgccgctcatacttgggggagataactctatcagctactccacaataaaagcgatagcacaaacaaaaggaacgacagcggtgattcaatttgatgcccatcacgatgttcgcaatacggaggacggggggccgacaaacggcacccccttccgccgccttttggatgaagagatcattgaaggtcaacatttgatccagctgggtatcagagaattcagcaacagccaggcctatgaagcatatgcaaaaaaacataacgtgaacatccacacgatggacatgatccgggaaaaaggactaatcccaacgataaaagagattttgcctgttgttcaagataaaacagatttcatttttatatctgttgacatggatgtcttagaccagtcccatgcacccggctgtccagcgattggcccgggcggcctctatacagacgaattgcttgaagcagtcaagtacatcgcacaacagcccaatgttgccgggattgaaattgttgaagtcgaccctaccctcgattttcgagatatgacaagcagagctgcagctcatgttctgttacacgcattaaaaggaatgaaactctccccattcaagtgatcttctggcaggttgtattttgggtataggaaactcatctgcctaatgaatggcagttaaaaggagggcgagacagtgaatcttcaggagaacagcagccaacagctaaaacgcacaatgaaaagcaggcacctatttatgatctcattgggaggcgtcataggcacaggacttttcctcagtaccggctatacgctacatcaagccggacccggcggtacgatactcgcttatgtaatcggcgggttgatgatgtacctcgtcatgcaatgtctcggcgaattgtcggttgccatgccggtgaccggctcttttcaaaaatatgctacaacatttatcggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattttaggaggagccgccatgtttggcctgatctctttaaacggaacggcggatgctcctatgttgtcaaacttcacggaccatggcgggttgtttccgaatggctttctcgccgtttttatcgcgatgatatctgtgagttttgccttttctggtacagagttaatcggcgttacagcaggagaatcagcaaatcctcaaaaggatattccgcgatccatccgtaatgtcgcatggagaaccgtgatttttttcattggcgctgtcttcatattatccgggttgatttcttggaaggacgcaggcgtgattgaaagcccgtttgtagccgtatttgcggagatcggaatcccttacgctgctgatattatgaatttcgtgatattaacagccttgctgtctgtcgccaactcaggcttatatgcttcgacccgtatgatgtggtctttagcaaatgaaaacatgatcagctcccgttttaagaaagtgacatctaaaggcattcctttaaatgccttaatgatcagtatggctgtatcttgtttatctctcgtttccagtatcgtggcccctggaactgtctatgtggtgatggtagcaattgctggatttgcaggagtcgtggtctggatgagcattgccttgtcccaactcttgtttcgaaagagatttttgaaaaaaggggggatgtaaaagatctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctgatctaccatttcaaaagaagtgttacaaaagcgaaaaaaatcagccaagaggaatatcaggctgatcacatcctgtaatcaaaaaagcacaccccactcaggatgggatgtgctttatttttattcagtaatcaacgtatgaatcagcttcggcgccttcgcttccgcggcgatgcggatgttgtcatagacttttgcgatgacttcatcaacgttttcgcggttggcgtaaagcgtcacgagcggttcgtctttttctactttgtcgccgaccttcttgcggagaatgatgccgacggctaaatcgatctcatcttcttttgtggcgcgaccggcacctaacagcatcgccgcgacgccgatttcgtccgcaacgatttcagagacgacacccgcttctttggcaggcacatcaatttgatatgcggcttgcggaagcttagacggatcgtcaacaattgagctgtcgccgccttggtttttcaggaaatccttgaatttctcaagtgctttgccgtttttcatgacttcttccagcttcgctctcgcttcgtccaatgtatcggcttttttcgcaagcacaaccatctgactgccgagcgttaagacaagctcatgaagatcctcaggcccctcgcctttgagtgtgtcgatcgcttctttgacttcaagcgcatttccgatcgcaaagccgagtggctgggacatgtctgaaatgacagccattgtttgacggccgacgttatttccgatgcgtaccatcgctttggcaagttcagctgcgtcttcttctgttttcatgaaggcgcccgctcccgtttttacgtcaagcacgatggcgtccgccccggcagcgatttttttgctcataatcgagcttgcaatgagcggaatggaattgaccgttcccgttacatcacgaagcgcgtacagttttttatcagccggcgttaaattgccgctttggccgatgaccgcaaccttgtcgcggttcacaagtttaataaattcatccttcgtcagttccacgtggaagccgtcgattgcctctaacttatcaatcgtgccgcccgtatggccgaggccgcggccggacattttggcaaccggtacgtcaagagccgcaacaagcggagcgagaacgagtgttgtcgtgtcgccgacgccgccggtggagtgtttatccactttaattccttcaatggcagaaagatcaatcgtttcaccggagttcaccatagccatcgtcaagtccgcgcgttcacggtcactcatatcctggaagaaaatcgccatagcaagcgcgcttgcctgataatcaggaatgcttccgtctgtatagccgttcacgaaaaattgaatttcttcagtggtgagttcttttccgttttgttttttgatgatgatatctaccattctcatgtttggtcaccgatccttttcgattaagttcagtaaatcaagcccacaattgctgctgataaaaagctgacaagcgtagcaccgtataataatttcaagccgaaacgagcgacgacatttccttgcttttcattcagtccttttacggcaccggcaatgattccgattgaggagaagttcgcaaatgacacaaggaataccgatacgatcgctgttgtacggccgctgaaatggaaaccgttttgcgtaagcgacgtcatggcgacaaattcattcgataccatttttgttgccataatgcttcccgcattaacagcttcattccatgggatacccacaagaaaagcgaatggagcaaacacatatccaagaatgccttggaacgaaataccgaatactgcattaaaaatgccattgatcaaggcaataatcgcgacaaatccaatcagcatcgcagcgacgacaaccgctactttgaaaccgtcaagaatgtattctccgagcacttcgaagaaggattgtttttcctcttcctcaacacgaagcatatcctcttcttttgcaacctcgtacggattgataatagaagcgataatgaaaccgccaaataagttcaaaacaagcgctgttacaacatattccggtttcagcattgtcatatacgcgccgacaatcgacattgatacagttgacatcgcagatgcgcaaagcgtgtacaagcgctgctgatttaaaagaccgagttctttcttcaaggagataaatacttctgactgccctaaaatcgcagaagccactgcgttatacgattccaatcttcccataccgtttaccttgctgagggcaaggccgatatatctaatgataaacgggaggactttccacttttgcagaatcccaatcagagcagaaataaacacgatcggcaagagaacattcataaagaatgtcgtttggtccgcattcaccaagccgccaaacacaaaattaattccctctgccgcgtattcaagcaggtaaccgaatccttttgcaaatcctcccacgaggaaattccctatcccggtattgaggagaatgtagccaagaataaattgcaaaatgagcataacaacaattgggcggatcttaattctttttttgccgctgctcgcgatccacgcgaggcctaaaaacacgattaaaccgataatcccaatcaaatacttcatatgtgtttctcctttatttgtattcgcttacaatcactgtttcctcagaaaacggaaagcagtctgccttccgtcagctcttaatagttgtctccgcctgatgcattttctccttttacgatagaaacgcctgcgctggcgccaattcggcttgctccggcctctaccattgtgtctacatcttctttcgttctgacgccgccagatgctttcacgccgatatcaggtcctactgttttgcgcattaaggcgatatcttccttcgttgcgccgcctgtagaaaagcctgttgatgtttttacgaaatcggctcccgcagacaccgctaaacggcatgcacgttctttttcttcatcagtcagaaggcacgtttcgataatgactttgacaagcgcttttccggctgcagcttccactacaccgcggatatcagcttccaccacatcgtcttccttgtcttttaaagcggcaatattaatgaccatatccacttcagtggcgccttttgaaatggcgtcttttgtttcgaacgcttttgtttcagttgtattggcaccgagcgggaagccgatgaccgtacaaacgtcgactccagttcccttaagctcttttgcagcaagctccacccatgtcggattgacacatactgaagcaaatttgtatgttttcgcttcttcaattagttttagaatttccgctttttgtgtatgcggtttcaaagctgtatgatcaattatgttggctaatgacatccttcgcacacttccttttttgttaagatattttttagcataaccgacttttgaacatatgtaaattggtaattgaaattttgttcaacgaaaggtttgaacgtgtcacaaatcattaacaagcgccctcgcggtatgctggtcaatgattaaaacgttggcatattttccggttaatgctccgtgaatggaagatacttttctgcttccgccggcaactaaaatggagcgttccttcagcctgaggtcttcaagctcaacaccgatggtccggtcattgatggcactgctgcaaatattccctttcgcatcaaaaaagcgtgaacaaatatccccgacggcctgttttttcagcagggctttctcttcttcgttaaaatatccgagccgaaacaacagcgcttcatcacggacagtcccgaccgtaaagagagcgatattcgcctgcttgcccatctcaataatccgctcaatatgacggtctttctccaccattcgcttcacatccgcattatcaaacacgacgggaagcgggagatagcgaggcatcgtttgaaaagcctccgcaaacagctgaatcgtttcagccgaatacgtgtttacccgggaatggctgatgccgcctttcagctggacgacctcgacgccttttacttgcttcggctgcatgttttgcgcgatttgatacatggtggttccccagctgacgccgacaatgtcgccgtcttttaccgtttcatgcatatattctgcaccatagcggcttaggtcatgtgtaattcctgcataatcgggtgtcggggaaaacacaacatgcgcctcaaggagcccgtatttctcttcaagtatggaaccgagcgcatccaaatcctcaaaagggtccatgacgcgaatctggacataccctttttcctttgcatattgcagcagccgggaaacggttggccttgaaatgttgagctgctcagcaatttgctgctgactgtagtcagactgatagtaaagccttgccgcttctatgcttaattgttgtttttcccgatccattctgcacctccctgtggatcagtcctgataaaactgcttttgatttgcttttattatacaggctggcgccggctttcatccacctgatttctaagaaactgaaaaacgctctgggcgcggacctgcccagagcttacttctcccaggtcatatgctgataaatgcctttcataatggcgtacattccatataggatcaggcctaatgccaatatagacagaatcaatttgccatgcggctgttgcgcgagttcggcgagcgcgccgtcaaagcctcttgtgtcgtcgggatcagcggtcatggctgtcttgatcagaaaatagccgatagcagagaaaataatggcccgggcgatattgcctgcgcgtccggtgtttttcgtgatgcatatcatttgtttgttcatttttgatgtatcaaattctttcataaaagcagcccgaacgcctttcataaattgaacaatcgcaaatacgataaaacccgcacccgtaagccctgtgagccattggccgaacggctgcgccaatacataagcggaccacgtctgttctgaagtgccgccgtccccttggccaaacacaaatcgcaaggcattccaagcgatggatgtgtaaacggcggcactgaaaaagtttcctattctccgtgacaggcctcgcctgctgtttccgtgcccctccgtgtccttgatcgcgcttaacaccatccagatcacatagccgataaggccgatgcctattaaaaaaagcaatagtgacccatacggcatgcgtgatagcgtttggagagctccgctcgaatctttcgcgcggcctgccccggcagccgtcataaaggccaaaaccccaagcagaataaaaacgccgccgaatgcaaaataaccaagcctcccgaatcgcttgatccaaggcttggtttcctgttttatttttgacatgtaccggtctttcaccgccatgtgtccaaccctctttcacagaagtctttactgtaacattcccgattggacaaagttgaaacagctctgcctcagctatggctggctgagatacgtttttgctgtttagctgattgtgcaggtgtcatccaagcagccgctgcggcagctgtgactccgcctgctaatttcccaatgatcatggcagccgccatttcttttttcattccagccacaaaaccgagatggctgccgagtacaaaggcgccgctgaccgcaaacgcgacattgatgacctttcctctcggcgtcatatcctttaatgaagccagcattgggatatggtgcgccaaagaggtcaccaagcctgctgttgctgtctcatctaaatgaaggtgtttccccagggcctgaagcggttttttaaaggtttttgtaataaaagccgtcattggaaacgcccctgccagggcaatggcgatggtccctgtcgtttgtatccctgtctcgacattctccattcccggaatcagcacaataccggtcatcgtttcaacggagacagctgcaagcccgataatcgcaacaacactgaccgctttcccgaagagatgaaacaaccgaatcatactgtcggtataacgccataatccaaaagcgatcacagcagataacagactcgggatcagaaggtttttacctatcatgccgatgtcaaagcccgcgcataatccgccgatgaaacaaccgatcggcactgtgcacagcccgattaatatgcctttcgcaaaatacggatgatcctctatttcgatgatgccaagagcgacgggaatcgtgaagacgattgccggtcccatcattgttcctaaaaacacccatgaaaacagtccggcctgcggatctttcgccatttctccagccagcgcatatcctcccatatcaatcgccaaaatggtgttcgcaaaggaagaagggtccgcgccaatcgctgtgtaaaacggagcaacaatgggaatcaggattgctgccagcacgggcgccagcgacacaattccgatcatggacagcgccagcggcccatagccttaaagccgtccgcaaaccgctcgcctagcccccatctgtttcccaaacaataatccgccgctccccatagtaaaaaggcagccaaaatgaatacaaccgcgtcattcaccgtcatggttttctcctttttcaaacgtatgattggttttatcatatcatctgaaatcaccgaatagagttgatcttattcaatatgagctaaaaattcttttatatcggctttttcaacggctgttatgatgctccgcgctttttcttgcgggaccgttaatgtcaatttttctattatgtcttcttcagacagcttatttcctggcgccccttttgggcagtccacacgcgcttcgcaaatccggccgtctgataaataggcccggacaatcgtgaaacggccttttggaacggcatggggagccggctgagtagcattgtcatatacgcgctgaatatgccctattgtcgtttgaatgccgtttgggatcggctggctgttgaaatgttcaacggtcaggtcgtgtccatgcaaagcaagagcaatcacatattcaacgctgaaacggccttcctctccagttttcggagatctttccgtcaatgcagcatctccgcctggcggaaaaatcacttcaatacgttcggtattggcagcagaaatggtttcttcggagataagctgtcgtaccgcatctgcagcatggtgtgccgcggaacaaaatggatagattttaaaccatagacccggctgcacaattctccacggtgccccccaatcgtttagcaaagtatgttgtgctttttcaacgtcaccgtacagactgaagaaaccagtttctccatcaagtgccgtgcgggacccgccaaattctgattgggccagcttaacggccagcaagccagcctgagcagccagaccggcgtgcagcggtttcatttctgttccaaattgcaccctcatcccagcagattgcgtagccgcaaaaccaatcgctttttccagcttttcctgagtcagctcctcagcataacctacggcgcaggcagcagcgatggcaccaagcgtacctgtattatgccagcccttctcatagtggcggctgccaattgattctcccagccgtgccatcacttcaacaccaacaacataagcgccaagaagccgctcgtcatgtccgcgagcggcagaagcaataagggccggtacgatgactgcactggggtgtcctcttacatcggagtggacatcatcaaaatccaatgcatgggcgataaatccattgagcatcgcggattgtaatggcgcggcctttttgccctgtccgataacaggaacaaggggccggcctccttcatcctctatcagacggaggagcttttgaattcctttatcttctcttcctgcgaatgaagcggcagtaaaatcaagtaatcctttttttgcttcgtgaatcgcgtcaactgaatgctcaggttgtgacgttctcacagcctctgcaagacctgctgtcagcccttgtttgctcatttgatggtctccaatacaataaccgccagctccgcaaagtattgagaggcaaccgtaagggcttcttcatccagtgtaaaggccggatgatgccactcctccgtcccgttcgttcccatccagacaaaaaatcccggaatcttctcttgatacagagcgaagtcttctccgcccggagactgctcagcgtgaacggtttgatagccaagccgtgccgcagcttcggatgccgcattcaaaaatgtgccgtcattctgaacggaaggcaaataaggaaaccacttgaattctgcttgtgccccatagcccgctgcaattccttcagccactcgtctcatatgctccggaacagcctgcctcgcttctttttgaaaggttcgaaccgtcccctccatttcagcttggtctggaatcacgttccacgacgtgcccgcctgtactcttgtgatactgacgactgcgttttgcagtgagctgatattgcggctgaccacagattgcagcccgctgatgatttgcccggctgcagcgattggatcaatactgttattcgggatgccggcgtgtccgcctttccctttgatgacgatttcaaaccggtcaacacttgccatgagcggaccttcctttacaccaatggtcccgacaggcagatccggcttattgtgcatgccgaaaatcgcggaaacgccatcaagtacgccagcttctatgacctttcttgctcctgcggcgatttcttctgccggctgaaagataaagcggactgtacctttcagctcggcccttctttgattcagcaacatcgctgtgccaataatagaagcagtatgaaaatcgtgtccgcacgcatgcattgtgccatcaaccttagatgcaaacgggagattcgtctgttcttggatcgggagcgcgtcaatatccgctcgtattgctatcacggggccgtcttcccgtcctttgatttctgcaatcacgccagtctccaattgaggaacatcaagtatttcgatttgctcctcctcaagccagcggcggatttttttcgtcgtttcaacctcttgaaatgacagctcaggatgttcatgaagatcacgccgcatattgattaaacaggtatgaaacgctttgtcggccattgttcttctccccttcttatataagctctgcaggctctcccacctgcttgataaatcgtttcgtccgttcgtttttcggatggtcaaacagttcttttggcgttccctgctcgataatatggccgtctgccataaaaatcactttatcagcgacctcttttgcaaacgccatttcgtgtgtaacaatgatcatcgttgtttgcttttccgcaatggatttgatgacctgaagcacccctgtgacgagctcagggtcaagcgctgaagttggttcatccagcaaaatcgcatgcggattgaccgcaagcgcccgggcgatgccgattcgctgctgctggccgccggacattgtgatcggatagctgtcagccttatgctccagaccgacttgtttcagaatctccattccaatacgtttcgcttcgtcgcgtggtttatgttgagccacgattaaagcttctgtaatgttttgcagagccgttttatttttaaacagattgtagttttgaaagaccatggccgtttgctggcgaagccgatatgcttccttgcgtgtaaacttttccgcgttcagtttggcttctccgatttcaataagtccttgatccggacgctctaatagatttaagcaccggagaagcgttgattttccggaaccggacggaccgatgattgccaccacttctccgcgtttcacttctagatcgattccgtcgagcacgacgagatctttaaacgctttgcgaatattttttactgttatcaactgatttcacctctaagtccggtatggcttgctcatggcacgttcaaacaagtcctgcaaaatgctgtagatcatggtaagaacccaatagacgatcgcaaccgccaagtaagtctcaaaatatttgaggtttcctgaagcgtacatcttcccttgggcgaacatctccatgacccctaatgtaaaggccagtgacgtttctttcaggagcccgataaatgtattgcccgttgccggaatcgcatttcggatcgcttgcggcaaaataatccgtctgtatgcctgaaattttgtcataccgacagacaggcacgcctccagctgcccgtcatcaacagaattgagggcggcccggaagatttctgccaaatatgctgcattttttaagcttaacccgatgatggcagctgtgagagctgtcattttgctcatctctggaaacagctgcggcagcccgtaatagattaagaacagctgcaccagtgtcggcacgcctcggaaaaaggatatatacagctttgacagctgatgaagcactggaattttgttctttgtaatgagtgcgagaataagtcctccgataatggcaaaaatcatagccgctatggccataaacaacgtgatcggaagggcctgaattaaagtcgggaacgctgatatcatgaattcccaatcaatcgtgttcattctggtgattcaccgccgtttcttaatgcttctgttctactgtgatatcttcattaaagtatttttcagagagttttttcagtgttccgtctttacgcaattcatctagggccttattgacttttttgcggagcttgtcgtgcgcatcgtccttggcaaatgggaatgcaacctgttcgtaaacaatcggatctcctgcaagctttaatggcaaaccggtcttcttgatttgcgcgatcaatacagttcggctgttgacataagcgtctacacggccgtacgcaacatccttcagcgtaccctcttgtgtttcgtacgttttgatattgatttttttatcaggatctttgctttcaaggtttttcgcgtgatttgaaccgagaacggctgcgactgtcttgccttttaaatcgtctactgatttgatgtctgtattgtcttttttgacgacaatctgtgttcccgcataagcgtatggtttcgtaaagttatacgtttccttacgttcgtctgtcacagctacctggttggaaatggtgtcaagcttgcctgtttgaagctctcccatcagcccgctgaattcaagcagcttccagtccagtttcatgtcaattttcttagcgactgcttccatcacttccacgtcaaaacctgtcagctttccgttttctttataagcaaatgggtaactttgtcctgtcgcaccgacatgaagcacattgtcatcctctttactgctgctgtttccattgccgcaagctgagagcaccgctaataatgcagcaacgaccagcactgtccattttttcatcttcatttgattttcccgccttttctatttttatagatcatgtcgcaattgttttttcatatagactgtgatatgcccttttccaaggtcttgttcacctgagcggacatatccttttcgttcgtacatctcaatcagccacggatgcttatccgctgttccgagtgagacaaacggaacctttaacgtatcgcgaaggattgtttcctccagccattgaagcagctttgttccgattcctttttttccggtgtcggggtccacagcaaaccaccagatatgcggaacgccatacggtcccggctgttttccccaaggcattctcaaggtgatagtcgcgatgatccgcccgtcttcttccatgacgtagcaagcattttcccgaatatttttcagcaccaaatccaaatccgcatgagcggcagcaaaacgaatgccgagctttcgaatcggttcataagcccgcaatgtcagctcgagaagctgttcggcatcacgttcaactgcaaggcggtattgtggcttcatctagcgttcctccttactttgcatagcggtttaccggcttttccaaaccgaagtgctctcgtaatgttgtgccttcatattcttttctgaacacgccgcgctcctgtaaaatcggaactacttgatcaacaaacacttcaattccttctggaagaagcggaggcatgatgttaaacccgtcacacgctttcttatccacccattcctgcatcttgtcggcgagctgctccggcgtgccgacgaagatatggtggcctctggagcctgcaacgtatttgtaaagctctcgtatcgtcatattgtccctttcagccatttcctgaacaagcttgaagcggctcttcaccgcattagaagcttctgcgtcaagcttcggcagcggcccatcaagcggatatgccgacaaatcaattccgcctaagtaattttggagaatttgcagaccgacagatgggataatcagatcttgaagctccttgtatttggcttgcgctgcttcttctgtatcggcaatgattgggaaaatacccggcatgatggcaattttttctggatcacgtccgaattccgctgcctgttctttaatggattgataaaattcctgagctgattccaggtggttttgtgctgtgaagatcacttctgctgttctggcagccaacgcttttccgtctcctgatgatcctgcctggataatgaccggctggccctgcggcgttcttgaaacgttcagaggtccgcgaaccgagaaatattctcctttgtggttcagctcgtgcattttttctttgtcaaagaattcacccgtttctttattacggataaaggcgtcctcttcccatgaatcccaaagcccctttacaacttcgacaaattcctctgcccgctgatagcgcaaatggtgttcaaggtgcttttcaccgctgaaattcagcgctgttgattcaatagatgaagtgacgacgttccatccggcacggccgttggacaaatgatccaatgacgcaaactgtctggcaatatggaatggctcgctgtatgtagtggaggctgttgctgtcagtccgatttttgatgtgacctgcgccaaagcagagagcagggtgaatggctcaaaccttgttaatacatttgggtgtgatttgctgtcaatcgaaaggctgtccgctaaaaacagcatatcaagcttgcctcgctccgctgttttcgcaagctctttaaaataatccaaattcatgctcgcatctgacggcgcgtccgggtgccgccaagacgcgacgtgatggcctgtacctgctaaaaatacccctaatttgatttgtttctttttgcttgtcatgacgatactccttttatcatgtttttaggctgaataatccgaaaaataaactcctatattcctagtcgtttaatatgaataaatcaaaatgtacctttgtcttggacgtttgtcaatgagttaagattaattttttctattcaagcgaaaagacccttgcgtgaccatgatggaacggcattgattcattcaactagtgcaacctctatatcggcaagaaaactgagtctaatgaagcaaagactcagttttcatccaagaatttcatataagatttcgccatttcctttgccttttcttcgcttttgcaaaccgcctatccattcagacgccgtaacgattgtataaaaaaacagctgactccagatattcaaaccggaatcagctgattgatgtgaattaattaagctcatgaatactctcttctgctttagcggaaaacactttaggctccaaacagtcaaggtcttcatgaaataaatttactttttggatttgccgattgtcatagtggtggaaatagtagtttccagtttcgttgcacatcacggaagtatattgcgtataatgaatttcgtcttcttccgttatcactgcgccctttggtatcgtcatatttgccaaaatttgaaaagcggctgttacacctttcgtttcatcggccgccggctctagatgttctttcaaataaacagctctgacaaaccgggaaggcggtgtataatcccccggcagaccaacagttcctaagccttggccaaaagcagaaagggctaatccgcccatctctttgctctctaattgcttcggtctgattcctgtatattgctgcagattggttacatgccatataaagtcggggctgttcgtcatgacaccaggttgattatcatagactttgaggccgtctgctctcggttctatcgtcaggcttcggcccgtccggtctgacaatatccagtgaagcggtaaaactgtatccaatagatctaattttttctctacaatcgttaaagatcgaatcttttcttttacgtcttccaaagacttacagactgacagcacccatgtcacaaactcatgcggggcaatgtgaacggtatcttcccgtatcgttttttcgtactccgcatagcccggaaaataaagtgcagcacacgataaaccgttttcattaacgccgtctgcaaataaaatattaccaagttttcttcccataccgataaatgcgtactgtgtctgatgggcctttccgtcagcttcgctattccaactgtaacggcgcggatagagaatcacctctgtccccagctgaaatgcaaaatccattgttctcgctaatacatgtttacggtcagcagtttccaatgtaagacttgtgcacatttgatcagtccccttttcaattcagattaatatcatacatattgtgaacgaattggttttatcagcataacgaaagtcaaatcggttcgtcaaagaattgacattacatcaaataaaacgaaaaaatccagcctttagaaggctggattttttattatttagccaaaacaagctcgtgaatcgcatgcgcaacaccatgttcattattggagcgtgtttgaaagtttgcggcttccaatacttctgggatggcgtttgccatggcaaccccgcagcccgcccattcgatcattgtcaggtcgttcccattgtcgcctatgcacatgacttccgcctgttcaattccaagcagctgagccagctggcgtacagcatttcctttgctggcttccgagtgcagaatctcataaaagaaaggcgcgcttttgaccattgaatatttttctctcacgtcttttggaatcgatgtaatgacgcggcttaagttctccggcttatcaataaacatcactttcgggatgaggatatcttttggcacctcgtcaatcttgcggaaatgaagcggcacctgtgtcacataggattcgtatacggtaaattcgctaatatcccggttaggcgtatacaaattagatgagtcaaagaaatgcatcggcgtcttcagctctaagctcaggtcatataatgaagccaaatcatcataaccgagagacagctccgagaccacttcatttgtatgcgtattttgaacaagcgctccattatacgcaataacatagtcgccttcttcaattaaattcagttcatctaaatatctctgcacacccccgataggccggccggtgcaaagcacaattttgacaccttccgcttttgccgcgtgaagggcgtcgcggacctcctctgttacttcatgatgatcatttaaaagtgttccatccatatcaattgcaattagtttgtacatcctgcatctccttcatgtcgttttcaggctatagtcccatcatatcgttttttctttttgatattcaaccggaagagatggttttctccgaattctatttagacgccgcccttgtcttcggatacgcaagcgcggtttccgctttctttctgccttgacgccgttttctgcttttttctgtttcatcagcagaaagccggcagctaaaaatggaatgccggttatattcaagatggcaagcttcacacccgcagcgattaaaaagaatccccatgaagatgatggattccgcctgatcatgacgtaagccgccatttccagaacgatcaggatggcatgaagcactatgccataaatcagcaatacaagggcaaaaaacaaaacataattcacgattgcccctgagtacatcatagcgcgcatcatttgtataaacgataaggactgcatggagccgctgatgacattagggttatagatcgtgtagtcactaaataactgtttgactttgagaaaagcccctaatataaatatccactgaatgatatgtaaaacaagccccgctgccaccagtctttcagctttttgatttctcatctttctcctccctgccggtctttgattcgattcttgtcatcgtttttctctgtccattttgctcccatatcaatgtcccgttttctcctcttatcagcgtgcttttgagcggataataggggccgaggtactgaatctcgatagacccgtcagtgctttgggaaatcaccttgtatgccataaaaggcagctgtacctctcctcttccttcaatcacttccgtttccacaacctcgtcttcggtaaatgtgactgttgctgatttcacaccgtccgttggcccgggggcacgcccctcatcccacgttccgtaataaaacggcgtctcttctttttgctgctggcagcccgataccatgatgcatacagcaattaaaaacaaaatgccatatttgtttctcaaggggctcaccatcctttcctccttttttgggcgaatgccgtgccactgtgccaatgactacataagttataaggaattcacccacaaggagactgatcacatgaacccttatcaatattacagccctcagctgcctcagcaggaaccttactatagccactatgagtacaattcttatccgcagcaggatgtatacgatccataccaaatggacagacagccggcattggaaagaagaatcgcagcacttgaacggcaaaatgaacagcagtcaagagaattaacccgtctgacaaacgaagaccgccgtcaaaatcgggaaattgcacggattgccgaacaggtcaatcagctaagccaggctgttgaacgccatacacgccgcctaaatcggctcaatcagcgcctccgcacagtagaaaacaggctgaatatcccatttactgcaggggaaggcggtttctgagcaaacaaagaaaaaaagcggaatacgattctcccatttcagggtttcgttttccgcgattcttatatgttaaaacggaacatttacataaaaagggtttgtacccagtatacaatctttaccgttttcattcaaagatagaggggctgaggaaaataattgtagttcctctttgacggaatttcttttcattcaagttgcatgataataccgactcacgtcaatcgatacatggagggatcattcatgcataatacacaacacggcttgcagcagctgaaccaatgccgccaaactgctcagcagctcattcagcaaacacagcaaagcagccagcaatatcgccaaatgcttcatcaggaacagcaaaacatccaaatgctgcagcagattctaaaccacgaacaacaagctgcacataccattcagcaagcactgcacgggcatgacatggcgattcaaaagtgccagcaggttgtcaacatgtgcaaccaaatgcaacaggaacttactggacaatccagcgtcatgaatacgaatgtgtctacacttccattcggccaaaacacgccatttcagcagcaatcctaccagcagtaacatataaaaagctcaacacaatgcgagtgttgagctttttttcttactgttctttgcgaatatgtatatcctgaatagactgtttcggtgcatgaaatctgctctcggcttcacttcttgcctcggcaaaagcccgcgcctccacatgatctttgtagacatccagctgaatcaaatacagcgggcgcactttaaatccatgaataatggttaccgcccataacgggaccacaataaaaacaccgggcagatcgggcaaaacaaaaccaaacgcaaaaatgaaaaaataaatgatgccgtacatgatccactttctatttctaaccttgatgccaataaataaaaaggcaaaaaaactggtaatggcaaaaggcatgaaaataaacagcatccaccagctatgcagccattcccaagcggcacctctttttgtaattcccatatttctctcctcctatttacctataataatcgattaggcataccgcgtcacccataaacgggaaaaactttctcccttaaaaatagtgatagacggagaacaggtttcttgctatattattaattgataatgataatcattactaatctattgagatacatagtgggagggttcttgatgaaaaagaacatattgctcgtgggcatgcttgtgctgcttctcatgtttgtcagcgcttgcagcggcacggcttctaaagggagctcaagcgattctgcttccgaaaaaacagaaatgagaacatacaaatcaccaaaagggaacgtcaacattcctgcacatccgaaacgcatcgtcactgatttttatgccggtgaattgctgtctgtcggggccaatgtggtcggctcaggctcatggtcatttgataatccgtttttaaaatcaaagctgaaaaatgtgaaggatgtcggtgatccaatcagcgttgaaaaagtgatggagcttcagcctgacttaattgttgtcatgaatgaagagaatgttgataaattaaagaaaatcgctccgactgttgtcataccttataacacagcgaaaaacgtagaggacacagtcagcatgttcggagatatcgccggagcgaaagacaaagcaaaatcatttatggctgactttaacaaaaaagcggaaacagctaaaaagaaaattgccggcgtcatcgacaaagatgcgaccttcggtatttatgaaaacacagacaagggcgaattctgggtgttcaatgacaatggcggacgcggcggccaagctgtatacaatgcacttgggttaaaagcgcctgaaaaaattgagcaagatgtcatcaaaaaaggagagatgaaacagctctctcaagaggttattcctgagtatgccgcagattatatgttcattacggattacaacccgaaaggcgaaagcaaaacactcgacaagctggagaattcctctatttggaagaaccttgacgctgttaaacataatcgcgtgtttatcaatgactttgacacgttctacccgtacgacccgatttctgtcagcaaacaggtggatatcatcaccgacatgctgatcaaacgggccgaagaaaataaaaaataaaaaaacggcacagtcatgacgctgtgccgttttttatgattcactttaattttgactgtacaaagtccggcatatcttcaaacttgacttcttcccaagtctcgacatactttcctttcgccttcaccttcaaatacgcgttcttccgaagctctttgccggcgaaaaaggtcacttcttctttttttccggatgcattgtatccgtctaatgtatactcagtaccgcctgggctaagatgtttgccatctcgatcaatctgcacatagacatcttgctggtgaataaacggattaaatctgtctgtaacatcgttatgaaaaaagagaagcccgcatattacggcagcagccgccaagacggccaggattgccattgcttttttcatctttgcactccccttacttgttcatttttttcaaatagcttgaccgcaccgcgaggaagaatagaagctgaaaaatgaaaaaccctccgatggtaagactgagcggtcccgctacatcggaatatccttccacagccaatgttctcaaggcaaacagtgtatgcatgacggcaatgacaaatggaaagaagaaaagaatggccaattgtattgtcacgctttgtgccatttcacgctcgctcaggccgattttggccagtgaacggtagcgctcccggtcttcatctaaatcagtgaacagcctgaaatataagaaacttgctgccgcgacaaagaatacaattgcgataaacaggccgataaataaactcaggctcggcagctgcaccgtatcatagtaagtcccggcttttgaagcaaaatcagaatgcacgtcgatataattgccgtaaatctcattttgcaaggattggctgatctcaagactgtctttccaatgatcatagctgtagccgtataatgacgctttatcaccgagtgatttcagctgatcaaaggtttgatcattcaccgcgatgatggcattcaatgagatcagcggttttttgacttcttttaccgacagtttttgatcagacatctcccctttttggttcagcagcttcagctgatccggcgctttgtttttgaaattgcggtcatacgttcccgggaaatagacagcctcgtcttctttcaggccgttcactttgacatggaagtattttgccgcatccgattcactgatcatgtaaacagggggaacagtatctccttcctgatagcgaacataggaaacatctattttgtctttcttatacgtaaagccgtgtgttttcaattcatggtcaatatctttcaaatgagtctgttcttttggattgttgctgtaagataaatactccatttcataagcggactcttccgccccgacggtcgatttgtacatcgcgagcacgcctgtcgcagtaaacgcaaccgcggaaataatgctgacaataaagaacaggcgggcgttgtcttttaaacgatagacaaggtcagaaacccagatgacgtttttcccgcgcagataaaaggttttccacttcttcagcgcgcgcagaatccatatgctgctttggctgaaaaagaaatatgttccgatgacggtgagcagtaaaatgataaacggttcggccccgtggacattgcctttaagaaccatgccgtacccgccgcaaagacaggcgatgccgaataaggacagaagcacggacggcttaggctccggcttaatcttgtcagtgccctttattaatttgataaccgtatttgatctgacaaaaaggatcgtaaactgcgataaaaagaaaaataagagcagaaatccgcaggccgtaataccgagcgctttccaaggcatatacaaaggcagcgcgtccatttctaaaatataagcgccgaccgtaaagaatgtctttgaaaaaatgaatcctccgataatgccggctgcaattgacatgacgccgatgatcatattttccgcagtaatgagctttctcagctgccccggcgtgatgccctgcatgagcagaatgccgaattctttatttctcgatttcaaaaatgcgttaaccgaatacagaacaaataagaaagaaaaaacaaagatcatccattccgcagcggttaagccttttttggcgatattattcaggtagccttcctttaatgccggatgaaacaggaacatcgcaaaggtaaagaaaatcaaaacggaaaaggcgctgcttaaaaagaatgcaagataggcccttttgtttctcgtgacgtttttataagcgaactgaagaaaggtcatttgcgtttccccccagcatagacagcacatcgagaatttgttcataaaatacttggcggttttccccgcggtaaatctcattaaacagttcaccgtcttttataaagatgacgcggcggcagtagcttgccgcaacaggatcgtgggtcaccatcaaagccgtgacttgatcatcctgattcaggctctgcatcgtttccatgacgtcttttgacgctttggaatcaaggttgcccgtcggttcatcggccaggatgagtgacggcttatgaatgaccgctcttgcgatggcggcacgctggcgctgtcctccggatacttcaaacgtccgtttgttgagcaggttttcgattccgagctttgccgcgatgccttgcagtttttcttccattacagacggtgcttctttttcaagcgttaacggcagcatgatattttcaccgattgtcagcgtgtccagaaggttgaaatcctgaaacacaaatccgagctgcttgcggcggaaatgagcgagctttgtccgcttcaggcgatgcgggttttctccgtgaatcaggatatcgcctgaatccggacggtcgatcgttgaaatgatattcaaaagcgttgtttttccggacccggacggccccattaccgccgtgaactcgccttcttctattgaaaatgaaatttgctttaaggcctgataggacacttgtcctttataggttttatttatatgtttgacttcaagcatattcgccatgaaaatcctccttatggttttattcttgttgatctgggctgctttcatgtagtgccgggacgttcaacataaaaatccccttgacataaatccatgttatcaaggggaaacaaagcgggctatgttgttttcttaacgcagccttacatttttgtaagaaatgaaaatcgaactgatgtcccttcaccgagagacgagctgatgtccaccgtatgattgagcttatctgtaatttctttgacgagatggaggccaattcccgtagattcttggaaacgccgcccgttttcaccggtgtaataagggtcaaacacccgcttgatgtcttgcgagggaatcccgacaccgtaatctttgacttcaagcaccgtcctgtcttcatcgcggaagacattcagctcaagtctgtcactcttgcccgctgaatacttgaccgcatttgtgaccacttggccgatcgcaaatttgagccatttggcatcggtgtaaatctgatgatcatcgcaaacgttcattttcggataaacgcgatattgaataaaaaatcgtttatagctttgaatgactgattggagaagctcgggcagggaaaccgcttcaattttaaaatcccgttcaaacaggtcgagccttgaagaataaagaagcgtctccagcccgaattcaatctgccggacttcttttttgatttgttcaaaaacgggctcatcctcttcttgaatgattaaattaatgaccgacagcggcgtctttacttggtgcacccattgattcatatacgtcacccgcgcgtcaagcttggcttcggtctcatggagcttctggtgctgcagccggaccagctccatctgcttttcatacagctctgaacagaacactgaagaaccgagatacgggatatccgtcccttcctgcccgagctgagccaatgatacacgccgcgttctttgtaccagcgataggcaagatagcccgccaaaataagaagctgcacgcccaatatgtaaaacaagtgagaaaaagaatgaagacccgcaaaccagtaataaaagaagacaaacagcccttgaaggagaaaaagcagaatcagcactgcatgagaccggagaaacagcttcatgactgcgccctcagctggtagccttcgccccgcaccgcttcaatagaaacaggcgcattcagctcccgcagtttttttctgagccgcgtgatatacacgttaagtgtattatcatcgatgaatatgtcggtgtcccacgtcttttccatgagacggtcccgactcgtcaccttttctccccgctcaagcagcacttccaaaagcttgctttcttttttagaaagctcgcttttttcatcctgaaaacgcagttcaaaccgttccacaaagagctgaacgccggcatattcaaccactttctctccctgctttgcggcgtactccccgtacgccctccggatctggcttttgattttcgccagcacaatatcataagaaaacggtttttcgatataatcgtctcccccgttttcaatcgccatcacctgatccatttccccgcttctggcagaaataaagatgatcgggcttgtggagtgctggcggatctgccggcaccaataatatccgtcatatgccggcaaattgatatcaagcagcaccacatcgggcttttcccgcaaaaagacatcaagaacagctgtaaaatccgcggcgaccactgtttgatatccgtatttttcaaggtaattctgcaatagtccgcgaatgtcttcactgtcttccacaatcataattttattcaaactgaaccactcccgtttcttacactgctgccatcatcataatcgttttgggcgtatggacgcaacaccgcacaaaaaaaccgccatctcggcggtttctggtctctttagccgacctgctgcttagctgctttaccggctgatccgaactctctcattttgcttcgcactgtctcttccacggcttcaatgccgggtgtcaaatagccgcgcggttcgtacagatcgctgttttcctgaaacatgcggcgtgtttcgtctgtccacgctaccatacattccgtattgatattgatcttcgcgtggccgagtgtgatggcttttttgatctgatcctgcggaatcccggatgccccatgaagaacgaggggaatatcagtcatgcgggagatagcctccatttccttaaatccgagattcggctcaccctgatatttgccgtgtacagagccgagggcggcggccagcgcgtcgatattggtttctttgacgatccgctcacattccgtgatatcggcatagcggaccccgccgaccaggccgtcttccattccgccgaccgtgccgacttcggcttctactgacacgccgtgttttgcggcataatcggtgacttcttttgtcatcgcgatattctcgtcaatcggctgatgggagccgtcaatcatcactgagctgaatccggcatcaatggcctgtctacagcgttccgcactgctgccgtgatcgagatgaagcacgaccggaacggtaatcgccatgtcctccattaacgcgcctaccatggcggcaatcgttttaaatccgcctaaatagtcgaccaggcgatcggaagccgcggcgatgaccggtgattgctccttttgcgccgcctgcaaaatcgccttcgtccactgcaggccgttgatattaaactggccgatcgcatactgctcccgctttgcatcttcaagaagctctttcatcgatacaaaagccatattcacccctcctttatccattacatgttgaagtattttgatacgacgtccactgttgtttttttcgctgtttgaatggcttcctcagcagtcagcttatagtattcaggccggaagagctcaaccgatacaacatcagagaagccgatttccttcagtgctgataagtgggcatctaagtcaattgccccttgtcccggccatacacgatcctcatctgttaaaaagccaattgggaaatcttctgtatcatcgatatgatagatgaagattttctttccgtccgcctgctttaaactctcaatatttgaacccattgcatggaagtgaaaactgtcaaggacaagcccgacattgtcacggttaactgtgtttacgatctcatacgcctgttcaaacgtattgaccgtacattgcggatggccgacaaattcaagcgcgatttttacgccgtacggctccgcgatatctgacagctcagtcagcacctctacactgctctttttgatctcttcttttacaatcttctgctctgtcacaagcggaacggccaccacatatttcacaccgagggttttgcatgtttccatcatgcctttaaattcagtgatgatctcgttgtggcccttttcatcacggttgttgaagaaaacgagtgcgtttaaggcaagcggtttgatgtggtgggtttgaaaatattccgcaaggtcatccaatgaatggtcttttaagtactccggcagcttatccattgtacggatttcaatataatcatagccatgcttttcgcatagttctaaatccagtttaaggtttgaattttccaatgttgtcgcttcattaaaacaaagtttcatgccagactcccccatctgcgttttagatatgaagggagttcggcaggaaggctgtcgccatatcccgccgaactccatgctcagcttatgccagacctaattcttctttcattttcttaagcataaatcggcttgattcatccgctctttcatcgacccaagcaaatacggcattcgtcgcaattccgtcgaacttcatctctctcagttttctgaaaatcgtatcaaaatcaacctcgccttggccaatgtccaaatgctggtgaaccgttactttcgcgtcaggcggattgacgatgtagcgaaggccatgagccgctttatgattataggtatctgcaaataaaacatgtgtgaggcggtcgccggcttcgtcaaacatggtctcgatgtcgcctttgccgtcatcatagaagaacgtatgcgcagtcgagtagacaagattgatccaatccttgtcaagcgcgcggatcatatccatcgcacctttgtgcgtttcgataaaatcgtatgggtgggcttgaagattgagtttcacgccttctttttcaaagactggcagaagctcatccatggatttgataaatttttcttcacttgttaaaggatcatatttcgaaccgctgaattcgctgttcatcaaatccacttcaagttcaacggcaatttcgattgcccgtttccagttgcgcactgctgcctggcggcggtcttcatcgggtcccgcccagtggtaaagaggaagaagcgatgaaagcttaacacctgtatctcttaaaaggcgctttaattgtttgatctttgctgaatcgactttcggatatttataaaacgggcaaaaatcctcgcgcggagacaattcgatatattcatagccaagctccgccgttttatagaccatttcctctaaagttaaatcatcacgatacatggatggatccaatgctaacttcatattttcactcctctgttttctagttttgaactgttgtaaaagattgatagaattccggtttttccttcaattcaaccttttctttttgtccagattcctgggcttttacacacgcgtcagtcgtgacagcagcaatatagccgtcccatgccgtcggtccgctgacctcgcctttcttttgaatcgaatcaataaagtcttggatttccacatcgtacgcagcgacaaagcgtctctgccaatccatcaaaatatcagtgctgaatttgccttcttttctcaagctgatgcttgatggctcgggaagcttgatgatgccgtcttctccgacgatttcgcattgaatgtcatagccgtatttacagttcacatagatttcagcattgatgacgataccgccttttgtttcaattacgacgatttgcggatcttttaaatgcgggagcgcatttttcgattttttcgggtagatgacttgaacggactcgtagtcatcgttgacgagccagtgcagcacatcaatttcatgaacaagcgtgtcgactacggccatatcggttgtgtagttatctcctacagtcgggttgcggtgcgcgcagtgaatcataagcggttcgccaatcacatggttatcaagtgcttccttcagctgtacgtaaccgctgtcataacggcgcatgaagccgacttgaacaaggcgtttgcccactttgatttcttcttcgacgattcgcatgcatccttcagccgttgtcgcgagcggtttttcacagaacacatatttctgggctttaatcgctttcagcacgcttgactcatgcgcaggcccccagcttgtcactaagacagcgtctacattttcgtctgcaagcaggctgtcatcattcggataaaccgtcgcgtttaattggtattgctcaacgaccttttgtgcagcttcttgattaacatccgttacagctacgatttctgcgccggacagcttgttcgtgatgcggttaatatgttcttttccgattgctccagttccaattacgccaatacgtaaactcattgacagccactccttctgttgattacataattttgctttctgttccttgctttacttggctctgaggagatccgtagagttcctcttgaatttgttcaagcgacttgccagacgtattcggcgcaaagagcagcccgatgatcatactggccgtcacacatccgagaagaattgcagccatcgttccaatgccgaaattggtgataatcattgggacaaacagactccaaatccctattgaaatacggacaaggaaaaacatcagtccttgtgcggaagcacgatattgcgtaggaaagatttcgctggcccataactgatagttcgcttgctgccctgctccgttattgatgccgatcacgacaataaacaggagcagaatcggcaggccttcaactggcagcagaaacagtgtccacccgatcaccgccatgaaagcggcgattccaaatacggtttttctatatttgtcggcaaagggcatgaagatcaaggcgacccccaatcctgtgaagataaacagccccatttgcaaaaggttggccatgttggcagatacaccgccgacctgctgataaatgtatggcataaagaagcccatgaccccggcggctaggttccaaaccaagtacacacccatcaaaaacagtatgctttttagatacataggcttgagcaaatcaaaatacgatgtcttattcaatacagccggcttctctgcctgagcttcctccggctgattttttgtctgccaggcgtctgattccggaagcctgattctcaggatgtacgtaatcagcgcaatcacaagcagatgggcaaatacgattttattccccaagagtcccaagtcaccggccagtacggagaggagcagtacaacgacagcgcccgcggcccaagcgacttgtgctacgccgcaatgcctggcccgattcttctttggcgcattttccgcaataatggtccatgacgcggttatgtcagctcctactgataaaccgataatgatgtaaccgcttaacaacatggggaaattaaccccgaacaaaaccaaacaaatccctagtgcataaaccagcatactattggtataaacagccttccgtccgactttatcagccaaaaacccgccaagcagcgcaccgacagcggcagaaatcgcatttgcgctcagcgcgccaagcagcccgatttgcgtatcggatagcttaaggtaactgacccataatgataaaccggcggagcctgccacaattgaaccggcatcaatatagttggccaatgctgccgcgattgtccgtttattgaaggctgaatctccattggtattgcccatatgttcattccccattaagccagatccaacaactgctgatcaatatagtttctcgcaatcaatgcatactccagcgggtttgcaacatcggggtcttgttcagcttcaatgacaatccatccggaataactgtgcttcaacagcagctgatatacttctctaaagtcaatgcagccgtcaccgggaaccgtaaacatgccttttaaaaatgattgccggaacgattgtccttcgagcctgcattgttccatgacattcaggcgggcatccttaaagtgcacatgcttaatgcggccgatatgcttctcaagcatccccatgtaatcgccgtcagaaatatacgcatggcctgtatcatagaggaggtgtacatgcgcagggtctgttcctgccatcaggcggtccacttcttccgctgtttggacaccagtgccgagatgatgatgatagacaagcttcaagccatgctgagcggcaatttcgccaaggtgattcagcccttcgcaaagccgctcccattcatcatccgtaaagtgcggcttctctgtgaacacgtttttctccaagctttgcacgctgtacgtttgttcagagacaactgcgacatccgcgtttacttgctgcaaatactcacaatgcagggtaaatgtctttgccgcttcaccaagtccgtcacgcaaaataaaactgctgaaccattttcctgcaatgcgtaagttccgaagcttcagctctttgttcaggatggcaggttcggggaaaaagccccgacctccgtgccttgaaaacgtgcgacaacgatatcacttaacaaatgctgaagtgtatttcccgctccaatttcaggcatgtcatcattccgccacccaatgggagcgattccccacaggatttcatttttgcccatctatggtgcctcccctctaatactgcttcgcagattccagctttttctcttttgcttcgtatgctttctgaacgctttcttgttcagatacctctgccaccccgacatgccaccagctgtcatagccgtccgtcattgttttaggcagcaccttcatttcaattaatgttgatacattctgtttcttcgcatcctctaacgccgcttttaattcttctactgtgtttgcgcggtaggttttcgcgccgtatccctcagcgactttcgcgtaatcgacattcaggatttggttgtcgtctgtgcggaactcgcaatagtagctgccgctgccgtgatccatttgcaggttgttgatgcatccgaatcctgagttgtcaaagagcagcacattgattttcttgttgtattgaatcgccgtgatcaattcagaatgaagcatcaggaagctgccgtctccgacgattgaatacacttctctgtcagggtgggccagtttaagaccgagtgtcccggacacttcatagcccatgcaagaatacccatactccaggtgatacgtattcggaacattagaatgccacagacgctgcaaatctcctgggagtgagcctgctgaacagatgatgacactgtcttcaggaatcgtctcgttgattgtcagcaatgccgttgtttgcggaagctccgtattcaacgcgtcagcatattcattcaggacctcttgagaaaaatgatgtttgatttccggatcaaatgcttcccgcttaaacgtcactttgctgagacgctcgcgttcagctagccattcgtccttcagctcccgaatcgttgtgccgaactcgctctcatagccttcaagcaaggcatgcagtttgccaagcgtcactttcgcatctgctaccacttggaatgcatcaagtttatacgcctgcattcggctgacgttaatgttcaaaaacttcgccttatcaaaatcaaaagcggtcttagaggatgtcgcaaaatctgtataccttgtgccgatgccaataatcaaatcagcttggcgggccgctttgtttgccgcaagtgtacctgtgatgcccattccgccaaggttgttcgcaaaatcagcctcaacagtagactttcctgcctgcgtttcaactaacggaatgttataggcttcagaaatggcgaccaattcatcgcgcgcaccggaatattttgcgcctccgccgacgagaatcacaggttttttgctggatttaatcagctccgccgctccttgaagctcgcgctcgctcggctgcatgcgatcaatatagtgaacccgtttgacgaagaaactttcatcaaaatcgtatgcttccccttcaacatcctgagaaatacaaatcgttgccggacctgcttttgccggatcagtcatgacttcaaacgcgcgcagcaaactgctcatcagctgctcagggcgcgtaatgcggtcccagtatctcgatacaggcttcaatgcatcgtttgtcgtaatcgccgcactgtattcttgctccatttgctgcagtacagggtctggctgtcttgtcgcaaatgtgtctgccggaatcaagagaactgggatattgtttgccaatgcagtgccggctgccgccaccaagttagccgctccaggtccgacggatgtagacaccgcatatatttttcttctcagcatttgcttgctgtacgccatggccgcatgcgccattccttgttcatttttcccttgatagactttcaaatggcctgcatcctgctcaagcgcctgcccgatccctaatacgtttccatgaccgaaaatcgtgaagatcccttcgacaaaaggctcttcctttccatctacatggatgtactgctggtttaagaatttaatcagcgcctgtgctgttgttaagcgaattttcttgcccacaaacgatcccacctttactcgatctttttcaattatgactgtgcttcaataagctgtacgatttcatcagcagtcggcatcgcttctgacgaactgtgcttgctcaccacaatggaagctgaagcactgccgtatttcaatgccgtttcgatgtcttttccggtgacaaggccatagataaaggctgacgcataggagtcaccggctccaaaagttttcagcacttttgtcttgtacgcttgagcgcggaatacctcgccggatttgctgtatgcgtaagagccttcgacgccgtgtttgatgacaacgaggtcggctgaatggccaaataaatgattgacggattcttcattgcttccgcctgtgcggttttccatcacatcaaattcatcgcgtgtgccgatgacgatatcagactgctcggcaaccaaagaataataaacggctgtttcatctgatgactgccacgtatacgggcggtaatccagttcgaacaccactttaacctgatgcttcttcgcgtattgaacagcttttaataccgcttcccgtgacgggcttttggcgagcgctgtcccggaaacaagcagcattttcgcatttgcgatgtagtcctcgcttacatctgaaggcgcaagataaagatccgccacatcatcgcgatacattaaaatgctgcattcttcagggctgaggatttctgtaaatgcaaggcctgctttgtgtccatcttgatcaacaaccatctgtgttgtatcaacgccggtctttctcatataggactctatgaatcttccatgctggtcatctggaattttgccgatgaagcccgcttttaagccaagcttcgcgctgccgatcgcgatattcgcaggtgaaccgccgacatatttcgaaaatgtcatcgtttcttccattgggcggttgtattcgactgcgttcagatcaatacatgcccggccgatggcaacaatatcaaaagccttctcttcattgaatgtatacttcatcgtaaacagccactcctcacttgttaacgttctaaaatccattcatgcgccgggtcattatgaaacttccatttccgcgtcggccctgccatgacatttaaatagtaggatgtgtatccgtccggcacacctaccgggtggtatcccgcaggaacgatgacaacgttttcattttctacagtcattgtctcatcaatagaacggtcatctgtgtatatgcgctgaaacacaaagccctgccccgggtctaactcatggtagtacgtttcttctaagaaagattcttccggcaagttgtcttgatcatgtttgtgaggcgggtagctggaccagttgccgctgtctgtatagacttcaactactaataggctgttagctgaagggtctgaatccggaagaatgttatgaacagtacgtttgtttgaaaacttcccgcgatgctcaattccgttgtcttccgctttgattagctttgtcggcagctgtttttccgatggagaatagcaaagcgccactcttgcgtcgctgaccgctgtaatctcaaatgcacggtcatttgacatatagacgctgtctgtcggttttcgttcaaatacgctttcacgcgtaccgatattctcaaaagtcgactcatggtccgtcactgtaatttttcccgttaccgccacaatacagatttcttgtttattcaattcttctgcatagctggaaccggaagctagatctaacaccttaaactctacataagtgagatcagagttggatttcgttacttcgtgcacgagtttgaccccattagacacttcatgcgactgcggcttacgcaacaaataactcatagagaagccctcctctttctattggcagaatgagtccgaacagcgcacatggacgccgttcggctgttcgtcgtttagttgaaatcaggtgccggatatcttgccgtcaccacttttttacgtgtatagaagtcgacgctgtcttttccgttcgcatgcagcgttccaaagaatgaagatttccagcctgagaatgggaagaacgccattggagccggcacaccaaggttgatgcctagcattcccgcatcaatgttttcacggaagtagcggattgcgtttgagttggatgtgaacaagcaggcgccgttcgcaaactcagacttattggcgatttcaatcgcttctttcaggtttttcacacggatgacagataagaccggagcgaaaatttcatctttccagatcgtcatttctgttgtgacattgtcaaagatcgtcgggccgacaaagtagccgtcgtcagacacattttcacgtccgtcacatacgagtctggcaccttcttcaagacctttttcgatatagctgagcgtgcgcttcttgttgtcttcgcgaatcaccggtcctaagaacacgccgtcatcaaggccgttaccgattttaatgtccgccactttttcctgcagcttcgccataaattcatcggcgattccttcttcaaccgtcacaaccgcacaagccatgcagcgttcaccggcagaaccgaaggcagctccgacgatgtttgtgaccgtgtcttcaagattcgcatcgttcaagacaatcgtatggtttttcgcgccagtcagagattgaacgcgttttaagttttcgcttccttttttgtagacgtattcgccgactggcttggagcctacaaatgaaatcgctttaatctcgggatgctcgagaatgccgttcacaacgtcatgcgcaccgtatacgacgttgaatacccctttcggaaggcccgctttttcaaaaagctcaaccaatttctctgttaacagcggagttcgctcagatggttttaaaataaatgtgttgccgagcgcgatcgccatcgggaacatccagcaaggaaccatcatcggaagttgaatggcgcgattccgccgacaactccgattgggtaacggtagttcgccgcttcaacgtccgttgcgatggaagcaagtgagtcacccatcatcagggaaggtgctccagcggcgaactctacgttttcaatcccgcgtcccacttcacctaaagcttcttttgtgttttttccgttttcaatggtaatcagatgagccagttcttctttatgctgggacagcagctgctggaagttaaatagaattctggcacggcgcggaaccgccaccttcgaccatgttttaaatgcttcagccgctgtttgcgctgcgtaatcaatatcttcttttgtagaaatcggcacttggcatagcacttctttcgtcgccggattgacgacatcttcatattgatctgttttgctttcaacccattcaccgttgatatagttttttaattttctgatttctgccattcttattgcctccttcattagtaaacacatacacttgtatggatggttcaggatagattcatatcaatatccacttttcagtaagccaagaattaaacgctttcaaaaaaaccaaaaaaataaatggcggatgcatatttacatacaagcaaccatttcatgcacaacaggttactttttggtcatttcttggttatattctaatcgcataatacccataagtcaatcataaacactaaattttttcattatttttattatattaatcttttaatcaagtaagagaggtaagagaaggccgtagaatcttgcaaaagatatacaccgatgttatcattttttaagcaactattgattaacttttggtttttattatatatttatgttacgtaaagattcaagaaggagttttttatatgaaactgatgcggattcaggaaatggaggagtacattttatcgcatggcactgtttccttagatgagctgtgccaggtgttcaatgtctccaaaaacacagtcagacgtgatatcaacaagctaacagaaaagggtgcgattgaaaaagtatacggcggcgtaacatctattgaaaaaaccgcattagttccttttgaaaatcgcaccattcagcaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgactcacggattgaccaattcggatctgctggagtatgaaattaaaaagaggatttcggaaaaagcaaaagaagtgtatctattggctgaccattctaaattcggaaaatcaacgcttctgacgtatgcaccgtttgacaggctgcattgcattgtgacctctcagccattagacgacgagtacacgcagtactgcaatgagcatcaaatcggcattcatctggcctaacgtttacaatagtgttgagagtctatcatccattttattctaggaggcagatcatgaaaaaagcgaagctcggaaaatcagacttgcaggtattccctatcggattaggaacaaatgctgtcggaggacataacctctacccgaacctaaatgaagaaaccggaaaagaattggtgcgcgaggcgatccgtaatggcgtgacaatgttagacaccgcttatatttacgggatcggccgttccgaagaattaattggtgaagtgctgcgtgaattcaaccgtgaagatgttgtcatcgctacaaaagccgctcacagaaaacaaggcaatgactttgtctttgataattcaccagaatttcttaaaaaatcagttgatgaaagcctgaaacgcttgaataccgattatatcgatttgttctacattcacttccctgacgaacatacgcctaaggatgaagccgttaacgcgctgaatgagatgaagaaagccggaaaaatccgctccatcggtgtatccaacttctctttagagcaattgaaagaagcaaacaaagacggtttggtagatgtattgcaaggcgaatacaacctgttaaaccgtgaagcggaaaaaacattcttcccgtatacgaaggagcataatatttcatttatcccttacttccctctcgtatcaggtttattggcaggaaagtatacagaagatacaacgttcccagaaggcgacctgcgaaacgaacaggaacacttcaagggcgagcgtttcaaagaaaatatcagaaaggtcaacaagcttgcgccgattgccgaaaaacacaacgtggatatccctcacatcgtattggcctggtatttagcaagaccggaaattgatattttaatcccgggagcaaaacgtgccgatcagctgattgataacatcaaaacagccgacgtgacgctttctcaagaggatatttcatttattgataatctgttcgcataagaagaaaacagccttctccaatggagaaggctgtttttttgtgcgataaattcctaaataactgattttgaagcaaaaccttacaaaatgagccataaatccgataaaataaaggtagtttatctcagaaagaaagtgattgagaaagcaaaagtatgaaacgttcatatcatccagctcatatgaaataaagctgacccagcttcttttatttgctggtcagaatagcagaccgtttcgatggtctatgggggaaaccgaatgaaacttaaatatgtaaaagccttagttgcagtaaccgttgctttaggtctactgctgccatcaacgatttctcatgcaaagagctttagcggccgctcatcatctagttacagcagccggagttcaagctcgtcatacagcggaagctataaatcaagcccgaaatcaagctacagctcaggatcaagctcttctagcaaaaaatccaagacgtctgacgattcatcatcatcgatttcgcttaaaaagaagccttcggaaaaggcaagctcatcaagctctaaaaaatcgtcagggaccttttccggcgctacatcaaaagtaagcggaaagacatacagcggaaaaacgtctaaagcttatgttggcggacgttatgtttcagtgaatcattactatcacgcaggtttcgcgccatcaggatggtttggatattatagcggatttacaatgggtatgttcatgatcagcatgatgcacccatggggttacacctatcatccagtcggaggcccaggctatgtttcgtatggcgcttcacccattgcctggatcgttgatatcattgctttgatcattattttaatcattgtcatcgcgttgattcgcgcatttaaagcaccgaagacgtacagaaggagattttaggcaatgagattaatattaaatgagcaagaaattgtagacggaatttgcgtgtatatttccaatgaagaagatatctaccctgaagacgttgaagtaaaagaactatcgtacaacaagcgtacagggttcttcgctgaagccacatttggcctgcaccacaagcagcttatgtcagatgacatttcagaaggcattattcagttcttagaggaataccacaacttcaatccggacgttaccgtcgttgaattgcaatttgataagaaaaaaggcttctccgccttggttttcgtcaacgaagcagaagaataaaaatgtcttaatcaaaaccttactccgcgcgggtaaggtttttttaatggtttctctgagcataaagttatttcgtttttcctaaactcagcggatctgtgatcatctcttttggctttaatgtttccgtttgttcaaaacaaatgtttcaaatgagataggaaatgggtactaatctattaactttgttatacattttagatactcattggctcaacaactgaggaggagacatttgtgaagaaagacacaaggaaatatatgatctactttttcggcgctttagggggactgctatatggttacgatacaggcgttatctcaggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgtgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggccgcagtacctgccgtgcttctattaatcggcatcgcgttcatgccggaatcgccaagatggctcgtgaagcgcggccgtgaagaagaagcgagacgcatcatgaacatcactcatgaccccaaagacattgaaatggaattggcagagatgaagcaaggagaagcggagaaaaaagaaacgacacttggcgtgctgaaagccaaatggattcgccccatgcttctgattggcgtcggccttgccattttccagcaggcggtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtatcggcatcacactgagccttgctgctttatcaggcgtgctcctaacgctcggactttccgcatcaacagcgtggatgacagtagtctttctaggtgtctatatcgtcttttaccaggcgacatggggtccggtagtgtgggtgctcatgcctgagctcttcccgtccaaagcacgcggagccgcgacagggttcacgactttggtgttatcggcggccaatctgatcgtgtcgctcgtcttcccgctgatgctaagcgcgatgggcatcgcatgggtctttatggttttctcagtcatttgtcttctctcatttttcttcgcgttctacatggtaccggaaaccaaagggaaaagcttggaggaaattgaagcaagcctgaaaaaacggtttaaaaagaagaaaagcacccaaaaccaagtgctgaatgagcgtacattataaaaaaaggaatcgtctccttatgggacgattcctttttctgtttacaccatgaccttgcaaatattgttcgtaaattccacagggtcctgaatcggcaggccttcgatgagaagcgcctgattgtacagaaggtttgtgtacaggctcagcttctctttatcttgttcaaacgcgtcctgcagcgtttggaatacctcgtgattcgggttgatttccagcactttttccgccttcacattttggctgtcaggcatcgcgtttaagattttttccatctcaattgtcacttcgccgtcagcagcaaggcagactggatgtgatttaagccgttttgagattctgacgtttttcactttgtctgacagaatgtttttcatttcctcaaacagatccttatacttgttttcctcttcctcggactgcttttgatcctcatccgtgtctatgccaaggtctccgcttgatacggacttgaattctttttcctgataagaagccagcattttaattgcaaactcatcgatgtcctcagtaaagtagaggatttcatagcctttgtccgccaccatttccgtttgcggcagtttctcaatgcggtcgtaagaatcaccggtcgcgtaataaatgtatttctgctcctctggcattctggaaacatactcgtctaagctgaccagttttttctcttttgaagagtagaataataggagatccttcaattgatccttattcgcgccaaaatcattgtacacgccgaatttcagctgtctgccgaacgacttgtagaacgtctcgtatttctcgcggtcttttttcaacaggctttgcagctcgcttttgattttcttgctgatgtttttcgcgatcagcttcagctggcggtcatgctgcagcatttctctggaaatattcagcgacagatcctcagaatcgaccatgcccttcacaaagctgaagtggtccggtagcaggtctgcgcacttattcatgatcagcacgccattggaatacagctccaagcctttctcatattccttggaatagtagtcaaacggcatgttttcagggatgaatagaatcgcgttgtagcgaacggctccatccacgctgatatgaacgtgtgtgagcggtttatcaaacccgtaatgcttttcagcatagaatttttcataatcctcatctgtcagctcgcttttgttttttctccagatcggcaccatgctgttgaccgtctgctcttcctgcacctcttcaaattcattttcgcttccttccttcggcttattaatggtggtatccattttgatcgggtagcgaatgaagtcggagtacttcttgatgatcgcttttaaacgatattcctctaaaaactcgtcatagctgtcatcttctgtgttctctttgattttcaggataatgtctgtaccgacagaatccttttcacacggctcaatcgtatagccgtctgcacccgcagactcccatttataagcctcttcgctgccaagcgctttactgatgactgtcacgacatcggcaaccataaatgccgcgtaaaaaccgacaccgaactgcccgataatgtcatgtccgtctttcagctcgttttcctttttaaacgcgagggaaccgctttttgcaattgttccaagatgctgttcaagctcatcctttgtcattccgatccccgtatcagagatggttaatgttctcgcatctttgtcagctgcgacctttatgtagtaactgtctttatcaaacgtaagcgcatcgtccgtaagcgctttgtaatagattttgtcaatcgcatcactcgaattggagattaactcgcgcaggaaaatttctttttgggtgtaaatggagttaatcatcatatccagcaagcgtttagactctgctttaaactcttttttcgccactcttgatcgctcctttaccattatgtaaacccttttcagcatctatttatcacataagatgacaattgtcaattagattgatagatgcatatatatgtaaatttaacattagttggatttgttttcactctttttctcactcattctcataaaaaagagaggcttcatcatcctctctttttttctgtgtcattccagcggccaaactcccgcttcatccatatatgcaccgggtagaaaaacaaaccgaacggtattaaaaacaatagattatgccatgaagcattcagaaatgcgcttgcagtcaccggaaacgtaatctcttgcaataaaaaagagatgacagtcagcacaacaaatgcagatggaatggtaatgaagcaataaaacttgagctccttcttatgctgtaccttcaaacatacaaacctcccaacaatttctaattcatcttaacatatgctggcctttcttttctcgcatgtttatcactgcacatagcgggaagacaaatagaaaaaggaggtctcgtatcatgggaagacttgaaaacaaaacagcagtgatcacaggcgccgcgacaggcattgggcaagcgacggcagaggtttttgccaatgaaggcgcgcgtgtgatcatcggagatatcaataaagatcaaatggaggaaacagttgacacaatcagaaaaaacggaggacaggcagaatcctttcacctcgatgtgtcagatgaaaacagtgtgaaagcatttgctgatcaaatcaaggatgcatgcggaacgattgatattctgtttaataatgccggcgttgatcaggaaggcggaaaggtgcacgaatatccggttgacctgtttgaccgcattatcgccgtcgacctgcgcggcacgttcctttgcagcaaatatctgattccgctcatgctcgaaaaaggaggctccatcatcaatacctcctccatgtcaggccgggccgcggatctcgaccgctccggctacaatgctgcaaaaggcgggatcacgaacctgactagagcgatggcgattgattacgctcgaaacggcatccgcgtcaattctatctcaccgggcacgatcgaaacaccgctgattgataaactggcaggcaccaaagaacaggaaatgggcgaacaattccgcgaagccaacaaatggatcacgccgctcggacgtcttggccagcccaaagaaatggcaacagtggccctgtttctcgcgtcagacgacagctcatacgtcacgggagaagacatcaccgcagacggcggcatcatggcgtacacatggcctgggaagatgctgattgatgagaaatggaaggaagaaacgaaataagagagggagcccctctctttttgtcttttaaagcaatacaaccttatatttcttcacatccaaaaactgcaaaaactccctcgccagcacttctggctcatgtgtctttccttcatccagccgatacaaaagcaacccgataatcattgcggatacataatgggcataaagctttttctctgcgtgaatatcagtttgctgatgcagataaaacgattccagcgctttgaacatatcaggtatcacatgaggaacaccccattcccgattgagaaaatggacaatgggtatgtttgacaaagcagaaagcagactggcgagcgccttctccgcttcctttaaggaaaattcattcgggctggaggcaatcgtcaggtgatcaatgatctccgcacatgatcgctgtatcatggtttggagcaattcctccttattggcatagtgatcataaaaggttgcacggcggatattgcttttccgggtaatatccgaaatcgtgatggctgcgtagtcttttttctccgccagcacgtccagaaatgccttctggagcgcctctctcgttcgaaccacccgcctgtcgatttgcttgtccttctctcgctctcctggcacagcttgtccaaacagccaataaaatctcttttgagaaacaagctcccataccttttggctgatagcttccggagtcgcggccgcatcctcattcagccaatacaggatgatcgcgtacgtgtacaaggcccggtaatgtccgtaaatttcccgttcgatcggcgtcaaattcacatggaccggagtcagcagaacatcctgctgaaacacatccttaaaaaaacgatggaaatgccctctgttcatcatcacagaaaaaaaggatcgatgttcatgaacaaaggatagcgtcggatgcaccgtttgccgttttttgttcaaatggagggtatccatatgactgaaggcgtcaaaaagcgctttgcccagcccttccttcatgtcttcgattaaatcctcaatgattgaaaacttatcctcataataaaggtagagcgatccgcggctcactttggccttctcagcgatttctttcattgtgatgtgttgaatatctctttctttcaataaggccagcaacgcctctttcacttgagcttcggcagattccggcacaaaagacacccccaatcattagacaaatgttcgatatatgtacggtaacgtatagatggttcaccgttgtctttcttacagaaaaggtacccccttataataggtccgagaaaagaagaaagcaaatgagggggattttacaatggaacagcaagtaaaggacgacattcagcgcgtttttcagcttcagaaaaaacagcaaaaagccttgcgcgcttcaacagcggaacagcggagagaaaagcttcaacgctttttagattccgtcatcgcccatgaagaagaaatcatcgaagcgatccgcaaagacgtccgcaaaccatatcacgaagtcaaaaaagcggaaatcgaaggaacaaaaaaagcgatcagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgccgctaaagtgataagagacgcttttgatgaaaaagaagtcgcgatttttgaaggagaggttgaggtggcaaccgaactacttgatcagccgttcgaccatattttcttcactggaagcacaaatgtcgggaaaatcgtcatgacagcggctgccaaacacttggcatctgtcacacttgagcttggcggcaagagcccgacgattatcgacagtgaatacgatctgatggacgcagcgaaaaagatcgccgtcgggaaattcgtaaacgccggccaaacctgcatcgcacctgattacctgttcattaaaaaagacgttcaggaccggttcgcggggattttacaaacagtcgtcaacgctggatttatggaggatgatcacaacccagaccgcagcaaatttacgcagatcgtcaatgaccgcaacttcaaccgcgtcaaagatctgttcgacgatgccatcaaaaaaggggcggaagtggtgttcggcggcgtatttgatgccagcgaccgcacgatttcgccaaccgttttgaaaaacgtcacgtccgacatgaaaatcatgcaggaggaaatcttcgcaccgatcctgccaatgatgaactatgaagacatcgacgaggtcatcgattacgtaaatgaccgcgataaaccgcttgcactttatgtgttcagcaaaaaccaagacctgattgacaacgtcctccagcacacgacatcaggaaatgccgccatcaatgatgtcgtcgtccatttcagtgacgtcaacctgccattcggcggcgtcaacacaagcggaatcggctcctatcatggggtatacggattcaaagagttttctcatgagaagggtgtatttattcaggcctctaaataatcgtaatgaagagaatctgcatcaccttgcagattctttttttatctttatatcacctaaataaagagattaaaagtgataaaataccattttcactacgagaccaaattcctctagtctatctcattgaaaccctgcagcctctaacgtataatatcccagaaaacttcaaaggagtaaaatgatacatggaaaaaccagcaggattttttgaatcgggcagcagcctctattattgatgtattcattatagctatattctctttcattatgattttcattaacaccttcattgtgttgccactcattgatgcagcaggtacacacatgtcagaagcccaatatgagtttttcatgttgatcattggcacaatccctgttttggccatcatatttattttcgctattctttactatagcttgctgacttcttcaaacatgcaagcaacattgggaaaaaaactcaggggcatcatcgttgtcaatcagtatggcgagcgtatttctttttggcacagcttcggccgtttcttcgcttacacattatctaagatcttatatatcggttttatcatggcggcctttccctctaaactggcattacatgattatatttgcgggacaaaggttctctataaaaataaatatcttgattgatcaaaaaaacaggctggcgaggttaacctcgccagcctgttttactatttcccaaaagccatcagcttcgtataacttccaatataaagtgttccgtcctcagcgagctgaggagaagacacgacgttactgtcagtttgatagctccataattcattgccgtttgcgtctgccgcataaaccttcatatcatctgacccgaaatacaccgttcccttcgcgtcaatcagcggcgccgttctgacagggccgtctgtatagaatgaccagttcatatccccgtttttgctgatggaaaacagctcgccgcttcctgagccgatgtagatattgccattatgatcaatcgcaggagatgagctggagaacccgtttagcgggaatgtccatttcaaactgcctgttgatgtataagcatacagctgtccatcttggttgccggcataaacgttgccgtccttatcaatcaccggatatcctttaaacgcatttgacgtcgttctggaccatttcacctgtccggttccggagttgatcgcataaaacacgtaattatatgtgccgacatacacggtgccgtttttggcaagcaccggcacagagctgacgacaccatttgttttcaacttccagcgctctgtccaagttgattttgacgtcggtttgatcgcgtgaacataattatcaagtgttgagaaatacaacgtcccgtctgaaccgatcaccgtttcagagcttggcccgccgcttaacggaaccgttgttaaaatttctcccgtttctttgtcaataaaataaatctttttgtcataggatgccaaatagataacgccgttggtcccaagtacaggagattgcgtatatgtttttccaagattgcccgtcacccatttgactgagccgtctggattaaaggctttcatttccccgtctctggaatgaagatatactgtgccgtctccgtcaatcacagcccccgctccattttgcggagtcgttctgatgtcgttttgccatttcagcgtcccgtctgtatttccggcgaaccggctttcgcgtgaccagttaaacatggcaggcgccatcgcttgtacctcatatcttcctgtcaaaaagccagatgctccattattttgagaaaataccgtttccgccgcataagcagctgtcggctgaaacactttggcagcgggcacatcagaaacagcaccggccgaaacagccgccgccaccgcagctcccgcaatcaaagctttcatacgaaatgacttgaccatcattgagacccccattatatgtaacttctaatttgtgaccatcataacatattcatccattttataaatatatttcacaaaaacatcacaaactagaaaactatgtaagagtattcacggacgttttttcagcacccggccgaaatgcagccacaaaccaaatgacgttgacagcagccgcagcgagactaattccgaaaacaaagatcacctcagaaagcagatggtcactaaagaaactaaacatcaagataaaaccggccgaagacaaatgaatcaaaagcccgaagccgcaaagcaccgccatgacatacctcattgcatcgactccgagcatataaacgagaaatggaatgaaatacaatacaaggatcataccgacagctgaccacatgccaaccgaattaaactgattggccgccgctcccgttccggccagcggcgaaagtgaagccgccacaatcacggcgcaaaaaagaaacgcagaaatggttgtcatgatcgccacgctattttttttagacatcaaactcctcctttaatagaaatattaaccttttttattataagtaagttgaaagttatattcattatattttttaaaaatccagaacatacagaaatgatatgattatttctagtatatttatatagtaaaaaacaaaggataaaagactcatttttctgtaatatcaggattttatcaccatactatattgcatgtacttgtttttcaaagtatactattccagattaattcagaggagagagaaaaatacatggaaaaaccagcaggattttggattcgttttttagcttattttattgatggcattattgtatctgttcctagttatattattctatttgtgatcaattctgtttttgtagctggggctgtggcaacaaacccttacatgacggaagaagagtatttagtgaaatacatgacgcttgcatttttgcctactatgctgatcatgatcgtcatcagcgtgttatattacgggctgctcacagcttctaaaatgcaaggcacacttggcaaaaaaattcttggcctgaaagtggtcaatgaacaaggtgaacgggtttctgtcggacagggaattggccgttactttgcctatatcttatctggaatcatcttttatatcgggtttatcatgatcgcctttggagagaaaaaaggcctgcatgacatcatttgcaaaacacgtgtcgtgtataaataatagaaaaaagtctagacgccaataggcatctagacttttgttttctttacaataggctgccacgacagatacgtagcgcttctccacagccactcaaacggccccatccgaaagacacgaagccaaaggtggctgaagaccatttgaacggcacaaacagcaattgtaatgagcacaccggcagcagggtacacttttccatacaggcccaagccgtaatgataaaaaatccaagtacatacaatagactgcatcagataattggtaaatgccatcctcccaacagcggagaatgattgcagcactgttctcactcttgttttatgataaagatagacaaccgttgtaacatagaaaaacatgaggaaaggcgcgccaatcagcaaacatatttctttatccgttacactgtacagcacctgggcgccgatgccgatgacaagcccagccatccacaatcgttttagtcctttgcgatgcttttctggttcatgcaagtaccgagatttcgctgccgcagctcccagcaaaaacatgctgaaatatggaatggatgcaaagaagaagttgagcggattatacgtaagcatgccattcgaagacatgtaaacaagacggtcgtggatccgctgttctgcaatatccttcaggctgccgcttccataaacatgaatcgcttgttttgcctgctgtgttaccgcttgtacccattcctgtccatttgattgatcaaaacttgtcaacatgaacggaatggaaaacagaagatacaaagagaccgcccatatcagcagtgttttcggctttgcttttcgaaacaagagcaggacaaatccgagcagggcatattctgttaaaatatccccgtcccatatcaaaaaggcatgaatcgttccaaacaagagaagcgccattaaccttctcacatataacggaacaaaccgtttccctttgttttctgctctctccatcatgacaaccatgccaaatccaaataaaaaggaaaacaataaaatacattttgtttgaatgaagaatttcagtatgtctgcggcggcaaaatcagcttcagaccacttatccatgaaaaaattctcttttccaagcatagacaaatacatatccggataactgaaatgtgccagattgacaaataagatgccgaaaatcgccattcctctcagcacatcaagcacaccgatccgctcatttgccaaagtcggctgtaatgaagacatagccatcacgctccttttttctgtaccttaagggtatgaaaaaatgaagcgcggaaacatcgatttaggtgtcaggccggcatgaaaaccttacaatcttgtcatctttatggtttcatcacctttaaatctaatgcttcgatattctgcaaaacgcgatcaaaacgcaaagcctgaggctcacatgggaagatgtggccttcatacgggtcgcccaacgtccggaaaaacggttcaaataaaccaggaaccaatacgcccaccatctttgtatagtgagaatcaaggcgataggagtgaacggtatttgcagggacatgcaggaaatctcccggattcagctgaatttcctggccatctgcccacatcgtcatctggccttcaaggcaataaaatgtttctgtatgatgttcatggtagtgatcaacgattcggtcacctttagggccttcagatgatacgacgataaactggccatctgtatttttttgtgcagccacaatgcggtgaagctgatctccagtcaacaggcgatctccttctccagattcaagaacgtatggaacggctccatctggcagctctgtaagttccgctaatttggccgaacatgcaggcttttcttcatctagaaatacaatgtccgctacagcggctgcttctgcaaatcgctcgtttgagacttcttcgcttgcgtacggcggatgttcagcgtgatcatacggattcccaataacggaatacaagtgcgctacgtttcctttcatcgtgtaagataccagtcttgttctgtggctctgcatccggtagctgtgcggtgttcccgccggaatgttggcataatcacctgatattaataaatagcgttcaccatcaagtgtcagttccagtttcccgtccaaaacgagaattccttcatgtgtgtccttgtggacgtgaagcggaaaggcatctccttttcccccggaaagaagcacgatctcaaacaaatcacctgtgctcctcccattcgccatcaccgtggcaacctgtctgccgaacagatagcgctcgccttctccgctccggagcaaataaggcattttttctttaggcaatgaatgtgtacataatgttttcatattatcgcttcctccaatttagaccagtctatatattatcatttatttgtctagaccgttctatataattgtaggagaaaggataacaaaatgctaccctttttttctcaccagcactggtatttgttcggcaatgagaagaaggggcgttttgtctttattcgttaacgaaagcatgatgccgccctcaatcatcgaattaatcagcgttccaagctgatttgcttcttcttctgcaaatccgttttccattaattttctggcaaaaaccgcttcccagcttttaaacaccttcatgcaaaccgtccgcagcggttcactgattaacgctgtctcactcgccagcaaaccgactggaatacctttaatgctttctgtgttatcaaattggctggctgtttttttgataaaaagctgaatcgcttctgttggatcagaggactcatccatgctttgctgtatcagatgttcaacaatcttacctgtatatgtaaccgcttcaattgctaattcttctttgccattcggaaaaaagtgataaagcgatcccttaggagcaccgctttcctttacaatctggttcaaacctgtcgcgtgatatccttgcagctggaacagacgtgacgccgtgtgaaggattttttcacgtgaatctcctctgctagtcattaaaacattccctcctaggtatggtagagcgacttatataatataaaaaagaaccctgtgattgtcaaaaggggtaagacccttccggatggggtaatgtacaaaaacagcgtctaggagggatctctcaatgacaatcgatcattcagtcacgaatacagaacagcttgaacgacaaaacccagccgtaaaaacaaagctcaaactgaaaaagcttaaggatcaggtgatcgtcattaccggcgcttcaagcggaatcggacttgtcacggcgcgaatggcagctgaaaaaggcgcaaaggtcgtggcagcagcgcgaaatgaagacgcgctgaaggagctcactgatgaactaaagaaaaaagggcacgacgccatatgggtaaaggcggatgtcggaaaagaagaggacgtcaaccgcatcgcagaaaccgcgatcagcacattcggccgctttgacacatgggtcaacaatgcggccgtctcgactttcggacatgccatggacgtcaccgtcgaagacatgaagcgcatgttcgacacaaatttctggggacctgtttacggaacaagagcggctgtcaaacactacaccggcagaggtgtgccgggcgcactcattaatgtaggaagcctgttcggagacaggggaacagtcattcaatccacatatgcgtctgccaaatttgcgcttcacggctggacggaaagcatccgaatggagcttgaaaaggaacaggcgcccgtctcggtaacgctcatccacccgggcagaattgacacaccatataacgagcatgcgcacagctacctcgacaaacagccggctcattaccgctccatgatctatccgccggaagcggtcgccgaagcgatcctgtttgccgccgaacaccctaagcgcgacatgtacatcggctcacaggccaaagccatcgccatgctgggcgcgctttttcctcgtctgaccgacagactgatggaaaaaatcatgtatcacagccagcatgccgaaagaccgtccaaaccgagagaagaaagcgctctttatgatgcgggctgcggtatgcatgacagaggcacaaataaaggatggatgaggtcaagaagctactacacaaaagcgacgaagcgcccaattgtatcggcggctgttgttgccggactagtggcttgggctgccgccaaacgatgcaggtaatctctgaccataagaaaaacccatgctgttccagcgaaccatgggttttttagctgttaatcgataaaagccttgttcatacgctgcagcagctcgccgaacatctctttttcctgtgttgaccattctttcagcatctgttcataacgttcaaggcgcttttgctgatcggcttttaatagttgtttgccgagttttgtaatggtaaacaggctgactctcccatcagatgggtctgagaaacgatagatgagctcctttgcctctaatgcagctgcttgtcttgaaagagtagaaatatcaagcttaaacgattcagccaattccttaacacgagcaggcccaaactcatccaattgtctcagtaataagtacgaagatctctccaaattccctgttcttttctctgattgatccagataaacagctctcctgataaaagtcgtcagctcatattcaattaattcaactggattttgattttgcaatcgctctcgctccctattccaatctccggcattgacaacatcatatatacttgtataatacaaatgtacattaactgaataaatacaagtcgttatatgactaaatcaattattatacttgtatagtacaatcatataaaaagaaagtaaagcgattcctcagaaccatcctagaagcaagcaccagaaaggaggaagctgttctgattggagagcagcacttgatgtgaaagtcatacgaattatcttgcaagtgttgatattatatgtattttttatgatcggggaagccattcagcatctgtttcatttacccgtgtcaggaagcatcgttggattggtattgcttctgatctgcttgggcctccgtattgttcccgtctccatcattgaagacggagcagggtttttattatccttccttccattgttgttcatcccggcaatgacaggagtgataaactatccgtctctcatttcattcaatggtctgatgctgctgattacagtcgttctgagcaccatcgtcacgatcattgcggctggattcgccagccagctattagagaaaaaagcaaaaaaacgggaggagaaagagaaatgcagcaagcatgtatcgcgatcattataattcttttaacagttgccgcttatttagcgatggtcaaactctataagcgattcccgcttccatttctgatccccgttctcacaacgaccattttgattgtagcggctttgatgatgtttcatgtttcctatgaaggctatatgatcgggggaaatggatcaattctttgcttgggccggctgttgtggcgctggcctatccgctttataagcaatggcatatcattgtcaaacattgtgttcccattttaggcggcgtcctggtcggattatgcatgggaatgatcagcgggctgatcttcgcagaagcattcgggattgatcatgatctcttattatccattctgccaaagtcgatcacaacccctgtcgctattcagatcgccgccggtcttggcggcgtcccttccatgacagtcgtatttgtcatgattgcgggcttttcaggcgtcatcctcgggccgcttttcctaaaatggcttcgcatacgcagctccctaggacaaggcattgcattaggcagcgcctcccatgcactgggcacctccaaagcattggaatatggggaactggccgtatccatgagttccgtctccatgacgctttgtgcggtgctcggctcattcttcggcccgctcgtcgtctggctgtttcatatttaacaaagaaagactgccccgggggagggcagtcttttttgtttaagaagcaaaaaaatcaatcagcggctgaaagtccttagataaatcaacgtcattcggttctgcttgaagcaggcggtcaatcatgtgctccagttcctcaatatgatgttgatctgtatattcaatgaagtttaagctttcaagccaatcccgatatgaatgtttggctttgccatagctgttcccaaagacaaggcaaggtgttttggtgataatcgagaaaatcatcgcgtgaaggcggtcggtaatcaccaatttactggagccaatgcggtctagcatctccataaaatgcttttcacgatcggcgtagtcgatggtgtcgaccgtatccagcaccgtatcggtacgctctgtgtaagttgttttttctgcccattgcttcatctgtgaaataaaatcttcgtcagttactttctccttatccgctcttaaaataaagagaacgccgtcccgctcgagctctcgcggcacaatatccaaggaaagcaccatgtccggtgtaaagatcacattggagttgaaggtctccttcacaacatccagtgtttgcgtctcacgcgcagcaatcgttaaatttgtattttgatggtacgcatcctgtgtttttttcttttccttctgtccttcctctgtatcctcaaaataaacggattgtggcagagaaattgatttgtagtctttaaacgccgaaaagacctttcttctgtcttcctcaatatcaagataaaggtttcctaaattccctccgcctgtaaagcagacaatatcgtcttcacgaatgatctccttcaccagttcaatgccctcatccgtcgcataatccataatctcaatgtattcataatacggaaaatgatttttgataaatttctcttccgcatacgcaatcgcttggtcgccaatgtttgtgtaactaggggaaccaaacaaaaatacttttcgtttatcatttaacagagcttccggctccacatttggcgcaatgccttttactagtttttttcctttgatttcttgtacagtcatatctgcgtcctccttctgggatgaattcctcattgtgtgttaactgtctctacccaaaaagaaggatggctatgcattggcgtgtgcatcggctatatcagaaacatcgttttcgccaattggatagacgctgcaatgtctcgcgccgttctttccatatattccgcggcatgttcaaacgcgtcttctagcggcacggctccgggaacgatgctgaaaagcgcatcgattccgtgttgatagacggcatcactgtctcgtgatactgatcccgcaataccgatgacgggcacatcatatgatttagccgctttggctacgccgatcggcgtttttccatgaaccgtttggctgtcgatccgtccctcgccggtaatcacaagatctgcatcctgaacgatactttcaaaatcaaccgcattaaggacaatatcaatgcctcttttcaggtcagcctgaagataagtcagcaggctccatccaagaccgcccgctgcaccggcgccctctgtatctcggaaggttgatccgagctctttttctgccatatcagcgaaatggcttacgttctggtctagtacatccagcatgtcggccgtcgcgcctttttgcggcccgaaaacagccgtagcaccctttggtcctgttaacggattgtccacgtcacaggcaacttccagtttgacattccgcaatctggaatcaagcccgctaacatctattgatgcaagctgagataacgcgccgccccctgggccaatctcgctgcctgagttatcaagaagccttccgcccaatgcctgaatcatcccggctccccgtcgttcgtggcgcttccgccgattccgatgatcaatcgctccgctcccgcatcaagagctgctccgattaattctcccgttccccttgttgtagtgatgagcggatttcgcttatctacaggcaccagatgcaatcctgaagcagcagccatttcaatcacagctgttctcccatcccccatcatgccaaagaaagctctcaccggttccccagcggccctgtgacaacttgctctatgatccttccgttggtcgcatcgaccagagattgaacagttccctcgccgccatccgccatcggcaattttctgtaatcagcacccggaaagaccgacttgaaacctctttctatcgcgtctgcggcctccagagctgataagctttccttaaaagaatcaggtgcaatgatgattttcatccaaatcgcctctttcaaaacatgattcacttatgctagttatctccaatgtaccatattccatttagaaataaataccataatgattaggaaaaattttattaaaaattagaaatgaaagtgtttgcataaaagaaatattcacgttatcatacttgtatacaagtatacttcttgagtgaggaaggtgagtgtatgctagactccaaagacctgttgtatcccgcaaaatggctctcaaaagcgtcaaccggggttcgtgtcgcatacgagctgagaatgcggatcgtttcaggcctgattgaaagcggtaccattttatcagaaaatacaatcgccgccgagttttcagtaagccgttcgccggttcgcgaagcgctaaaaatactcgcatccgaaaaaatcatccgcttagaacgaatgggagcggtcgtaattggtttaactgagaagaaaatcgcggaaatttatgatgtgcgtttactattagaaacatttgtctttgaacggcttgtcaaaatagacattgagcctttagttaaggatctcagcaaaattcttgaaatgatgaaagtctcaatcaaatatgaggacgctgacgaattttcatttcaagatgtgctgttccatgaaaccattatccgagcgattgatcattcatacattcagatgatctggaacaatctaaaacccgtcatggaaagctttattcttttatcgatgcgggtacggttaaaggaaaagtatgaagacttcacaaggattttagataaccacgagctttatattcaagccatcaaaacaaaggatagggcgctgatgattcagtctcttcaccaaaactttgatgatgtgcaggataaggtagaagacctatggctctcacaacaaatgctggcaaaaggagctgaatacaacaatgactagttatatgttaggaatcgatatcggcacgacaagcacaaaagctgtgctgttcagtgaaaacggagatgtggtacagaaagaaagcatcggctacccgctctatacaccggacatctcaacagctgaacaaaatccggaagagatttttcaggcagtcatccatacaacagcgagaattacaaaacagcatcccgaaaaacaaatctctttcatttcgttcagcagcgccatgcacagcgtcattgcaatcgacgaaaatgacaagccgctgacgccatgcatcacatgggccgacaaccgaagtgaaggctgggcgcataagatcaaagaggaattgaacggacatgaggtgtacaaacggacgggaacaccgattcatccgatggcaccgttaagtaaaattgcctggatcacgaatgaacggaaagaaatcgcttccaaggcaaagaaatatatcggcatcaaagagtacatttttaaacagctgtttaatgagtatgtcatcgattactccttggcatcagcgacaggcatgatgaacctgaaaggcttggattgggacgaagaggcactgcgcatcgcaggcatcacgccggatcacttatccaaactcgtgccaacaaccgagatctttcagcactgcagccctgaaatagcgatccaaatgggaatcgatccggaaacgccttttgtcatcggcgccagcgacggcgtgctgtccaacctcggcgtcaacgccattaaaaagggcgaaatcgccgtcaccatcggtacaagcggtgccatccgtacgattattgacaagccgcaaaccgatgaaaaagggagaattttttgctatgccttgacggacaagcattgggttattgggggacctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacgcggctcatttttcggcctgaccatgtcgcataagaaagagcatatgatacgcgcggcattggaaggcgtcatttacaacctgtacacggtgttcttggcgttaactgaatgcatggatggcccggtaacccgcatccaagcgacagggggatttgcaaggtcggaggtttggcgccaaatgatgtcggatatcttcgaatcagaggttgtcgttccggaaagctacgaaagctcatgtctcggcgcctgcattttaggcctgtatgcaacaggaaaaattgactctttcgacgccgtgtccgacatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaatagtacatgacatgaaggggagggcattaccatgccgttaatcatcgttgcacttgggatcttagcattactatttctgattatgggcttaaaattaaacacatttatttccctgctggtcgtatcgttcggcgtggcactggcactcgggatgccgttcgataaagttgtcagctccatcgaagcaggaataggggggactcttggccacatcgcgctcatcttcggactcggtgcgatgctgggcaagctgatcgcggattcaggaggcgcacagcgcattgcgatgacgctcgtcaacaaattcggcgagaaaaatattcaatgggccgttgtcattgcctcatttattattgggattgcgttattttttgaagtaggactggttctattaattccgattgtctttgcgatttcaagagaattgaagatttctattttatttctcggaatcccgatggtcgcggcactatccgtcacacacggtttcctgccgccgcacccgggacctacggcgatcgccggtgagtatggcgcaaacattggagaagtgctgctgtacggctttatcgttgctgttccgacagtgctcatcgcagggccgttatttacaaagttcgcgaaaaaaatcgttcctgcatcatttgcgaaaaacggcaatattgcatcactcggcacacaaaaaacgtttaaccttgaagaaacacccggctttggaatcagtgtctttactgcaatgctcccgattatcatcatgtcggtcgcgaccattatcgacctgcttcaagaaacaatcgggtttgcagataacggagttttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgcttttgatcatcggaggaggcggcgccttcaaacaagtgctgatcaacggcggtgtcggcgattacgtagcagacttattcaaaggaacggcattatcgccaatcattctggcatggctcatcgcggcgatcctgcgcatttctctaggatcagcgactgttgccgcactaagcacaacaggtctggtcattccgttattgggtcattctgatgttaacctggcgttagtcgtgctcgcaacaggcgccggaagtgtcatcgcttcacacgtcaatgacgccggcttctggatgttcaaggaatacttcggattaagcatgaaagaaacatttgccacatggacattgctggaaaccattatttccgttgctggactgggattcattttattgttaagtttagttgtatgaaattaagaaggagctgtaacacatgttcaatacgattggtgtcataggcttaggcgtaatgggaagcaatatcgccttaaacatggcaaataaaggcgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggatggaggaaactcccattatgaagacacagaaagaagatatgacgaactgaaggaaaaagggatcggttacctgggagtcggcatttccggcggtgaagtcggtgcattaacagggccttccatcatgccgggcggagatcgcgacgtctatgagaaagccgctcctatcctgacgaaaatcgcagcccaagtcggggatgacccttgctgtgtctatatcggaccaaaaggggcagggcactttacaaaaatggtgcacaacggcattgaatatgcagacatgcagctgattgcagaagcgtatacgtttctaagagaaacgcttcgtctgccgctagatgaaattgcatctatttttgaaacatggaatcaaggtgagctgaaaagctatttaatagagattacagctgagattttacgcaaaaaagacgaaaaaacaggacagcctctgatcgatgtcatccttgataaaaccggccaaaaaggcactggaaaatggacgagcatgcaggcgattgataacggtatcccgtccacgatcatcacagagtccttgttcgcccgctacttgtcatccttaaaagaagaacggatggcagctcaagacgtattagcaggcccggaagccgaagaaaaacacttggataaaggcacctggattgaatacgtcagacaggctctttacatggggaaagtatgcgcctatgcacaaggctttgcccaatataagatgtcatctgagctttacggctggaatctgccgctcaaagacattgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcactggaatctctttcccatgcttaactaccgcgctctcttattacgacggctaccgcacagggcgttccaatgcgaacctcttgcaggcacagcgcgattactttggcgctcacacgtacgaacggactgatatggacggcgttttccatacgaattggtctgaataacctgtcatcaacacggtcagttttcaactgaaccgtgtttttttcttctatcccaaacaacagaagacataagttatgttttaaatatcataaacagtgatacaataatagctagaaacaatccccaagatcatcatgtgacagcagcttgctgttccgttctattctgcttttggccattgtcctttgcccttgaccatggtgtcataaaatgttcaaatgccaaaacggcctgtcattctgatttataaaagtccctgaaaaccttgtctaattgagaatcagcctctcatttgttataaaagaaatgcataaatcctacctgtcacacctttagtaagatgaaaaaaagtaggttatggcttgacaaaaaatatatattaattaataattcatatataattagaattattattgaaagcgaatatgctttctaatacatttttaggaggaatatacattatgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgctcttaaagaattaggtgttgaagtatactctgtttctacagatactcacttcgtacacaaaggctggcatgacagctctgaaaaaatcagcaaaatcacttacgcaatgatcggtgacccatctcaaacgatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaaggagtgcattcaattggtacttgatgcaaatatcaaagcacaattaaatcaatatatgcagctaattgagaatgacattgttctcaaagttagcgcaggcgaagatgacatttcaaaggacatgctggctctcgttgatgagctggcttccatgtcatcgaaaatttcagttgaaaaagctgaattaaacagaacgccgagcttcagtgtcaatcgtgtcggagaagacactggcgtgactttcgccggtatccctctgggccacgaattcacatcattagtgttggcgttgctccaagtgagcggcagaccgcctaaggtggaccaaaaagtcattgatcaggtgaagaagatcagtggtgaataccacttcgaatcttatatcagcctgacatgccacaactgtcctgatgttgtacaagctttaaacatgatgagcgtgctgaacccgaacattacgcacacgatgattgacggtgcagcatacaaagcagaagttgaaagcaaaaacatcatggcagtgccgaccgtttacctgaatggcgaatccttcggaagcggccgtatgacgcttgaagaaattcttgcgaaaatgggcagcggcacagatgcatctgagtttgctgacaaagagccgtttgacgttcttgtggtcggaggcggacctgctggtgcaagtgcagcgatctacactgcacgtaaaggcatccgcactggtgttgtcgctgagcgcttcggcggacaggttctcgacaccatgagcatcgaaaacttcatcagcgtcaaagcgacggaaggaccgaagcttgcggcaagtcttgaagagcatgtgaaggaatatgatattgatgtcatgaaccttcagcgtgcgaaacgccttgagaagaaagatctgttcgaacttgaactcgaaaatggcgctgtcctgaaaagtaaaacagtgatcctttcaacaggtgcacgctggcgcaatgtcaacgtacctggtgaacaagagttcaaaaacaaaggtgtcgcatactgcccgcactgtgatgggccattgtttgaaggcaaagacgtagcggttatcggcggaggaaactctggtatcgaagcagcaattgaccttgcaggtattgtcaatcacgttaccgtgctagaatttgcgccggaactgaaagcagacgaagtactgcaaaaacgtctctacagcctgcctaacgttactgtcgtgaaaaacgcacaaacaaaagaaatcacaggtgatcagagtgttaacggcatcacatacgtagaccgcgaaacaggcgaagaaaaacacgttgaacttcaaggtgtattcgtccaaatcggtctcgtgccaaacacagaatggttagaaggaacagttgaacgcaaccgcatgggcgaaattattgtcgacaaacacggcgcaacaagcgtaccaggcttatttgctgccggcgactgcacagacagtgcgtacaaccaaattattatttctatgggatcaggtgcaactgccgctctcggcgcgtttgattacctaatccgtaactgatataagaaagccgcaattgccagattggcagcattgcggctttcttttttattccaaaaatattgcaagttttatacaactgtaatatagttgtaatgttagtgattggtcacttcacactcagcatatttgctgtttttaaagcgatacgcactgattttctatttaacgtgccctgatactttttgaccttttttttcagatctttaatggttttttcctttttggcattttctaatgccatcagcgcttcccagcgtttcgctgtttctgtggaactgcagccgctaactgtagtcacaggcggaagaagcttcgtattagatagtttttcgtcaaaaggaacggtatcaggaatcgctttctctttataaatatggtctaattcattttgattcaagaagctgatgaaatggtcaaagttttgcgcttgccgtttctcaggctgatgaaaatcaagtgtttcaattaattctgacagttttgtctgatcggttatctcatttgccatgacatgcgttaattgatggtactcagctaattcacgcattctggcatctttcggaagcaacaggctcggtgtaccggcaatcgtcgctgcgatatttccatgcagccttgcgccaaagctcaaatcggcttttctcaggaaatccagccaagtcggcacatttaaaaagaatcggactctatcattctgataagccgggtcttccatgctgaccggataattatcagcaggcttcgctagcgcaggcgcacccgcatacgtcagaatcatttcttttcgccattgcgggataaagtaatgattcgggaactctttcatgcttctcgtaatgaagtccagcacatgctttggagacagccttgatgagttaaccgtcaccatagattctgttgtgatattagtttctcttatcttcagttctctgccaaacgcatacatagaaggacacccaatcaccgtatggtcaatgccttcacggaaacctaatctggaaaggtatttcgctgtaatttcaccgcggacaccgatcatatttgatctctccagcacagcacttacaaacgcttttacatcctcatcaaaaggaaaaccttcatttaattttggttcaaacggagcccgcaaaccaacaccaatcacaacaaccggaatggttagtttcttaattaattgggtatatttccgtaaagaaggcacgaaatcctcgcggaatgcatctgccagcggaataatatacatatcataatttttattaatttgttcagcatccgctggattaatccgataataatcaggagtaatcgtcgttccttctgtcatcagcgtgcgaaacacactgtaggcatatactaggtttcctacgttgccgccaatggagttgcgaacaatcatttcagctgcattaaatgtatcaaatggtgatatgccagctcttattaaaatgtttttcaatgtgatgttgccccttcctcgccaaatttttttcaggagatttgcttagggaactctatcatgatcttaaaacttcagccggacacccgctttcatccctttttactcacaaactctctccctttcttccattctaatattaaattatacaaaaaaggatcttacaggtgaaatcataacatacaatcagcgctagtaatctattcccattattggatatcgggtcggatcatgccaaaaacccgaaccaggcactccggtaaaagtgctcgattcgggccagcttcttatagttcctcgccattcgtttgaatgacatttttgtaccactcaaaggaatctttcttataccgcttcatggatccgtttccttcattgtcacgatcaacatagatcatgccgtagcgttttttcatttcgccagttgtgaaggagacaatatcaataatgccccacggcgtgtagccaattaaatcaacaccatcgtacgtgaccgctttttctaatgcttcaatatgcgattttaaatattgaatgcgctccggatcatgaaccttgccgtcctcctccagcgtatccactgcgccaaagccattttcaacgatgaataacgggatttggtatcggtcataaaaacgatttaacgtatatctcagcccggttggatcaatcgcccatccccagtcactcgaagtgatgtacggattttcgacaccattcggcaagccgccatttacaatatcgccagtgttatcatttttcacatcgcttttcacagttgttgacatgtaatagctgaagcctaagtaatcgacggttccgtttcttaaaatctcatcatcgccgtcttcgaatgtgatgttgtagccttcgcgttcaaattccttcaacgcgtagcttggataataaccgcgcacctgcacatcagggaagaaatagcgctgcctcatttcttcttcagccagcatcacatctttaggattggaggagaaaggataaatcggcacgtgtgataccatggccccaatctggaactctggattgatgtcttttccttttgccactgctaaggcgctcgccactaattcatggtgcgccgtttgatacatgacttccttggcgttttcgttttcgtcaaccacaacacctgaattcgtccataggaacaacggattgttcacatccatttggttgttaatctcgttaaatgtcatccagtacttcactttatctttgtaacgggtaaagcaagcctctgcgaagttgacgaagaagtccacgactttccggtttctgaagccgccatattctcttgccaggtgcagcggcatttcaaagtgagacagggtaatgaccggctcgatcccatgcttcagcaattcatcaaacacatcatcataaaactgcaaaccagcttcgttcggttcagtctcatcgcctttcggaaaaatccggctccagccgatggacgtccgcagacattttaatcccatttccgcaaacaaagcgatatcttccttgtatctgtgatagaaatcaatggcttcatggtttggataaaattcgttttcttcaatcgtgtccgtgatttttctcggcacgccgtgcgcacccgctgtcatcacatcgacgacactcggcctttaccgccttgattccatccgccttcaaattggtgggcagctaaagcaccgccccataaaaaatcctttggcatgtttcccatgtttaattcctcctcagcttacgactgtaaatattttttgatgtaatgcactttcctcaatctcttcaatgaaagcttatcaaactcaacaagcacttcgccttttttgacggtatcgccttcttttaccttcaaggaaaaaggagtgccgcctaatgtcaccgtatccagcccgatgtgcgcaagcaattcgacgccggacgctgaacgcaggccaatcgcatgctttgtagtcgcaaccatgacaaccgtaatgacgccgggatggtagcatcgatttcacgatatccttcgctttaggggtagaccgcttcagcaccaatcgaagtctggtagcgcagcgagaagccccaatcacattctcttcccgcctacggcctctaaaatgtcttttgctagtctcgtataatctctcactttccccgacatttcacccacccctttgttttggttgcgctttcattataattgtaccggtataatatatcaataccgaaacaaaatatttacgcactaactatcattgtaagcggtttatgctataattttggcagtgaaactaaacgaataaatgaggaatgcgtatgttaaaataccagcaaatcgcagcggaaattgaaacatatatagaagaacaccagcttcagcagggagacaaactgccagtcctagaaaccctcatggcccagtttgaagtcagcaaaagcacaatcacaaagtccctcgagctattagagcaaaaaggcgcgatctttcaggtcagaggaagcggcattttcgtcagaaaacataaacgaaaaggctatatcagccttttgtcgaatcagggatttaaaaaagacctcgaggatttcaacgtcacctcaaaagtcatcgaactggacgtgagaaagccaacaccggaagcggcggaaaatctgaacatcgaaataaacgaagacatctactatgtcaaaagggtccgctacatcaacggccagaccctttgctacgaagagtcttactacaacaaatcgatcgtgacgtatttaaacaacgaaatcgtctcccactccatcttccattacatccgggaaggactggggttgaagattggtttttctgatttgtttctgcacgtggaccagcttaatgaggaggaagcggaatatttggggttagaggctggactgccgaagctgtatatagaaagtatttttcacctgacaaatgggcagccgtttgattactcgaagatttcgtataattataagcagtcgcagtttgtgatgcaggctaatagttttttattatagggctgcttcactatggaaggtgatcgacatgtacaaaattatcattcctgccatactagccatctttgcgctctggatactcttacagatttcactagagatgagcatcgttaagaatccaatgaactactttatcgtattcactatctttttcctctttgtaaagctggtgaaagaaaaacaataatagtttgggcgatgcaaacagaaaaacatccttcccttaacaaactcagccagtcacatgcattaatcttgatgttaatgatatataggtgcacataaaaagctacttcattgtgaagtagcttcctttattaaatgcccattttgatccatctagttttagaaaagcgaaggacaatcgcatttatgataatgattgaaactaaatacaaaataataaataaaacatcattactcccaagtgtcatgttatcagattgcagcactctttctattcggggatacatagtgttacctgcctcaaaaggagcaatgaaaccaaacgttttattgcttatagctactaagataacagaagtcatccaataaacgatactgacacctatactaattaatatattaggacataacatgcttatagttccgataattagaatatactgcagtataactgcagaaaataaaaaaagtaataatgcaaaatgcgaaaaatcatggtacatcaatgatatgattagcaggcctagcgttataaatgcaaaacattccaaaaataaaacagctatctttttataaaagaaagtatagatgttctctccaattaatttgtaaaagagaatatttttgtttgaatactctctattaataaagaaagctataacaaatgaaaataacatcaaaccaaactgggttgcaacagtataggagctaaagaaaaacatttcaggtgtaacattgctgactttatcaattccaacaagtaaaaaataacccagcaaaaataaaaatacaaacattgctcctaaaataatgataactttgttgctaatactctttttaaactctaatttcatctcaagcccccactgttttattactcatttatatacacttcaattaatttatccactgaatgatattgttgaatttcttggtgattaaatatataataatccccttctatcgcctttaaatcagacaaatcatgtgtaatgttgatgataatcttctcggggttctcctgaatatacttgtttaagaagccatgaatctctataaccgtttttttgtctaatgaattcgttatttcatctaaaacaataatatttttatcctctaataagaagctgagcaattttaatttttgcttttgtccatcactcaaatttttgatcagaactttcccatcaatattatccagattaagtaaatgtgcaattttatctatcatttctgcattaaattttttactcaaaaagtgtaataaaaagtccttagaaacatcattaggtatattcgacgagctggatattaaagaaacattttgacgaatatctctaccaattcttttgctattattcaacaaaaagtctttagcaagctgtgatttaccgactccattttttccaacaacgtgattaattttcccgctcgaaaaatgcaagtcggtgtcctgaagtaacgttttgcctttcacttttaaagtataattcgctatattcatatacatactcctaggaaatatttgtattttcaaggtatctctttcgtttccggtttggaactgtaagaaatgtttttcgatgattaatctggatatcttttactctagtttacaatatataacactcaatgtacaacaacggcagtttcctcaaggcaattccatacaagataactgacaaacaagctaaataaatggatcgtcaataccatatcaatgcatattgataacaacaataaggaggatactgaaccttttagcctaagcccttgactaaataacctcctccgtagattctgctgaaaggtttttcagctctagctgccttaatctttcactcgttttaattgtctctaaaagcagttatgcggtactatcatataaaggtccaatgtttaaaaataatgacatacttttaaattcaccttatcatgcacatgatcatatataggggtttattctaaaaaggggatggacgattttggaaagcaagtacctagatctactcgcacaaaaatacgattgtgaagaaaaagtggtaacagaaatcatcaatttgaaagcgatactgaacctgccaaaaggcactgagcattttgtcagtgatttgcacggggagtatcaggcattccagcacgtgctgcgtaatggttcaggacgagtcaaagagaagatacgcgacatcttcagcggtgtcatttacgatagagaaatcgatgaattagcagcattggtctattatccggaagacaaactgaaattaatcaaacatgactttgatgcgaaagcagcgttaaacgagtggtataaaaaaacgataaatcgaatgattaagctcgtttcatattgctcctccaagtatacccgctccaaattacgcaaagcactgcctgcccaatttgcttatattacggaggagctgttatacaaaacagaacaagctggcaacaaggagcaatattactccgaaatcattgatcagatcattgagcttggccaagccgataagctgatcaccggccttgcttacagcgttcagcgattggtggtcgaccatctgcatgtggtcggcgatatttatgaccgcggcccgcagccggatagaattatggaagaactgatcaactatcattctgtcgatattcagtggggaaatcacgatgtcctttggatcggcgcctattccggttccaaagtgtgcctggccaatattatccgcatctgtgcccgctacgacaacctggatattattgaggacgtgtacggcatcaacctgaggccgctgctgaacctggccgaaaaatattacgatgataatccagcgttccgtccaaaagcagacgacaacaggccagaggatgagattaagcaaatcacaaaaatccatcaagcgattgccatgatccaattcaagcttgagagcccgattatcaagagacggccgaactttaatatggaagagcggctgttattagagaaaatagattatgacaaaaatgaaatcacgctgaacggaaaaacatatcaactggaaaacacctgctttgcaacgattaatccggagcagccagatcagctattagaagaagaagcagaagtcatagacaagctgctattctctgtccagcattccgaaaagctgggccgccatatgaattttatgatgaaaaaaggcagcctttatttaaaatataacggtaacctgttgattcacggctgtattcctgtcgatgaaaacggcaatatggaaacgatgacgattgaggataaaccgtatgcgggccgtgagctgctcgatgtatttgaacgattcttgcgggaagcctttgcccacccggaggaaaccgatgacctggcgacagatatggcttggtatttatggacaggcgagtactcctccctcttcggaaaacgcgccatgacgacatttgagcggtatttcattaaagaaaaggaaacgcataaagagaagaaaaatccgtattactatttacgcgaagacgaggaaacctgccgaaacatcctggcagaattcggcctcaatccagatcacggccatatcatcaacggccatacacccgtaaaagaaatcgaaggagaagacccaatcaaagcaaacggaaaaatgatcgtcatcgacggcggcttctccaaagcctaccaatccacaacaggcatcgccggctatacgctgctatacaactcctacggcatgcagctcgtcgcccataaacacttcaattccaaggcagaagtcctaagcaccggaaccgatgtcttgacggtgaaacgattagtggacaaagagcttgagcggaagaaagtaaaggaaacgaatgtcggtgaggaattgctgcaggaagttgcgattttggagagtttgcgggagtatcggtatatgaagtgaggggtgtggggttcagggattattttctctgggctctttttaggctatccagattccaattccaaaacaccagtttaatgtaaatattttaacattatataaatacccactaatttacgatttgcataaatttatcccatactgcccctatgattaaagattcatattgcatcatatttattttttggaaaaatagtgtataattttattagcgtgtggctagatcttttcgcttgtgtttcgcaagtgttgacaaaaatggtgggaacatttgcttctcctattctcatattggtgtattcgccgatgtatccgatagttaccgcataatgagtagccacacgtttatttatatgggggatttttatatgagggaatttaacgatataggaacacggaatgaacttgcagattttctgaaaattcctagaaaacagcttagttatatattgtatgtaaggggcgttaataacttatacacatcgtttgaaatacgtaagaaaaatggtggtgttcgtaaaattaaggctccattagaggaactcaaagacattcaaagaaaactcgcagaagctttatataaacataataaaaaagcagggaaaaaaaataatctttctcatgcatttgaaaaaaacaagaatattataactaacgcaaaaattcatcggaataaaaggttgattttgaatattgatttagaaaatttttttgaaagttttcattttggtcgtgttaggggttttttcactaaaaataaaaatttcttgctacctagtgaagtggccacagttattgcacaattatcatgctatgaaggaaaactaccacaaggtgctccaacttctccaatcatctcgaacttaatttgtgggatacttgattatagattattaaaagtcgcaaaaaaatacaaattgaattatacacgttatgcagatgacttgactttttcgactaatgataaaaattttctgaatctacagacgaaatttcatgaggaaatatccaaggagttaatacaagccggatttaaaattaatgaaaaaaagacaaggctgcaatataaagattcaagacaggtagtaactggacttgttgttaataggaaaataaacgtaaatagaattttttacaaagaaactagggccatggcacatcaactttataaacaaggaaatttcaagattaatggtaaatatgccaatcttaatcaattagaaggaagatttgcctttataaatcaattaactcggtataataacaaaatagatggtgacaaacatagtttttataatttaagttccagagaacttcagtatcaaaaatttctattttataagaactttttcgctaattcaaaaccactaatcgtgacggaaggtaaaacggatattgtttatttaaaagcggcattaaaaaaactctgcaacgaatatcctgatttaatttctaaagatattgatggaacatttgagtttaaagtatcttttctaaaaaagacaaagaggttaggatactttttaaatattcaagatgggggcactggactaaagaatttaaatgatttttttaattctaataacgctaaaaaatcagctactaattatttgagttatttcaaaaaaattagtaatactttaccaaaaaaacctgtaattttaatgtttgataatgagattaaaagtggaaagaggaaacctataggtgattttcttaatcacgcaaagattgatgatgaaaaagtagaacttttgaaaagtgaatataaaattaatgttattgataatttataccttttaacagtacctctaattggcggaaagtctgaatgcgatatagaagacttatttgacaaaactactctctctcgcaaaattaacgggaaggaattcacaaagaaggataattatgatacttcgaaatactatggcaaagacatattctccaagtatattctagataactatattaatattaactttaataattttagatctgttttagataacataaacaatataatagacatttacacgaaaagaagagtagatacagaacacaacattgaagcaaaaaatatagacgagagtagcgaaaaaaaaatacctttagaaatctagtgttaataatacttttcaaaatatttgtagtgagtttttcaacatgacgtgctagaacaaatcagacgtaaacattttgaagaaattttagaaacacatttagaagaagttgataaaataaatatatctctagttagattcattttaaagcgtttgactgcaacatatattagattttcttattaggaacatacacaaactttctagttgttaaagaggtaattgttttactttcaaacaattgaactgcacaaagaaaccaaaaatcaaattggctcacagctttttaatatttatttgtatggattcgtttgtaagacatgttagatacaaaaaaatatggatactaagtacatttacacatgataataaatggaataattcagacagatttcacaagataatatatagaaataactgaccagtatacccaaagacagttaatattggaaattgggagaactggcttggatcattggtatcgtcctaaaaggagaaatttctctgaattaactccttgttaataagagcatttttagcagccacaagttgtttgtctggcaatcaagctcaacactggtatcgttctttaccacgacttaacttactcggatttgaagaaacaaagtgggcaactgcaaatcgcttttcttattatgaaaagccacttctttaaaaagaagtggctttctatttaaaactagagtgttagaaaacaccaaagttccatatatattaagatataacatcgtttatatgaaacaatctccgtgttttaatctatatttttcataaaaataaggttacctcttttaaaaattaatgctcctcatttgaaagacttattttcattccaaatcatcattgtttagtttagcctttacttcttttataaaattatcaaacatttcattattaaagtatttagatatgtactctttaagaatattaaacctttgtgttggtgttcttttcttaattagtaacatttcaatatcaaagtataacttatcagtaacttccattccatttgtcatttcatctagctgtttatcattcttttctaatttaataatatctttgatattaaagaagctcataatatttggccccattaataccacttttaaattattataaggctctctctctataattcttcgaatatgcatatcatcttcaaaaataaaaacttgctcttgtttttcatttaacagttggatcaaaagtttctctgacattattgccccacctaaagaaactacgttaactttttcatatcctaatatttcgacaagatttttttcttggattaacaagtcaaaaaatacttcttctatcttaccttctacataaattgtcaattcagatttatttttattatcaaatgtaattttttcctttttacttttttcaaattgtttgtaataggactgtattccattaatcctccgagctctcttaaataatggaatccaagagttattgtcgctccagataattggaagcgatgtatttggagtattgaagtcaaaagcaattaaacttccaatttgaccgaaaccaaaaggttgtttgggataagctattttcccataatattcaattcttttctttatacgctctcgctcttcatatgtaaatccttcataaaactttccgtcaagatcaataattgtgtctttagttgaatattcaattgcagagaatgtgtatgcttttgtttcttcttcaacctttcttataccatctttcattccacaaacagtcagtaagaaaatattattcacaccagatggcgtaaccttctctgttagcttatttatttcttttgtagcttgatgccccgttgataaaatatcgtctatcagaacaatgttttctatattccctgactctattaatacatcattatcactgaagttctcttctgataattcgttaatcaccctaaaatgataacttatcattgagccactttttccattctcaccaagacctgcaaacaaggtatttctatgggtaatctttgttcctttctctattgattttcttattagtttagagtatgcaattgcaagtgaattcttaatgtcagcaaaattcaagaaatttatatgttcaataattctgatagctagcttataatcttcagaatcaaattgtaaaatccaatttacaacatcttcgaatggaattgaactgttccagtttctgtgaatctcttttactctttcaagcttatctatcaacttttctggatatctcattttaattttcacctttaaatattttatatatgcttaattacgattgtatttatggtttctgtaatagtagaattccatttcattagcaaattttctataacactaatactaattaaaaatcttttatttctaaataaatatgtcaaaaaattctctaacataagttaaagcgtaaaaatctttcaacatataatcagaataaaaacttctaaattaacctcatttacttatgataaggctccccacgattaatccgaaaagcccgataaacctgctccaccaaaatcaaccgcatcaactggtgaggaaacgtcattttcgagaacgacagcttttcatccgctcgcttcatcacggcgtcgctcaatccgagtgatccgccgatgacgaaggtgactttgctttttccatatgtagccagcttatctattgtatcggctagttcttcggatgttttcatttttccttcgatggcgagggcgatgacgtaggcgtcggggctgatttttgataggatgcggtcgccttctttgtcttttatgattttcatgtcctggtcgcttaggttttccggcgctttttcgtccgggagttcgatgatgtcgatttttgcgtaggccgaaagtcgtttggtgtattcttcaatgccttgcttgaggtatttttcttttagttttccgattgtcacaatattgatattcacaggtcatccccactttaaaaacaagttattcatatatgttgtccacaattgtggatatcttttctgtattttgtgtaagatcattcgttccccactatatatactgcggggtctccacataattcacaggctgtggataaactgttagtatgttcgatttttctgatttcgggcggcagctcgtggtcgtctatgtacatatccagcaccgtttcgatgtgttcttcacaagaataatacgcttgtttcatgttcaaatcctccgatgttttcttccatttttacaaatgttctcttctcaatataacctatttattcacatgttagtagtgcttcgggctgagttttatccacaattcgacaaacaagctgttgatgactctatttcgctcgtgtgttagtttggatgtaaccgatgtgtggggaggtctgcatttgcgctttagatgggtttggctttttgtgatcatgttgctgcttgctgggtgtcagccgtcttattgggtgttggagaaggatcgacttgatgaagtgacagatataaaaatgtacgtaaatgatcttcaaatgcatgatgacgtgaaaggatatcaagtcttcaccattttagaagggagaaaaatggttattgtgtctctcggaagcagcgagaaagataagaagcttgaagtgtcagacgtcaaattctcacctaaagaaacgattgtaactgtgaaacgaaaacctgctcctacggcaaatgagaaaaacccttatattttgattggactggacaaaatcgcaggggatttcatcgtacaggatgaaacgggaagtcgatttgaagaaacggattaccagcaataaagccggcgttctgagaacgtccggctttttcttttacttcaatgttccatgcgggtcgatgacgaattttttggctgcgcctttgtcgaagtcgctgtagccttttggcgcgtcgtccaaagaaatgacagtggcgttgacggcctttgcgatttgcgctctgccgctcaggatcgctttcatcaaattgcggttgtatgtcatggcgggtgtttgtccggtgacgaaggtgtgggctttggcccagccgagtccgaagcggatttttaatgagcctgttttagcgtccgcatcctttgcgccgggatcttcggtcacgtataagcctggaatgccgaggctgcctccgacctgggtgacgtccatgattgagttcagcacggcggctggcgcttcccttgattgccgtgcccagatgcttcaaagccgacacagtccactgcggcatcaacggttggttcacctagtatttgttcaatttgttcgccaaggcggtcgtgtttttgcacgttgaccgtttcacagccgaagcttttcgcctgtgccagcctgtcttcgttcagatcgccgacaatcacggtagaggcgcctaggagctgagcggagtgtgcagctgccaagccgacaggacccgctcccgcgatataaacggttgaacctgtttgcacgcccgctgtgtaagctccgtggaagccggtcgggaaaatgtcggacagcatggtcaaatcgagaatcttttctaacgcctgttctttatcagggaataccaaaagctgaaaatcagcgtatggcaccatgacatattcagactggccgccgacccagccgcccatatcgacgtagccgtaagccgatcccggccggtccggattgacattcaggcacacatgcgttttctgcgttttgcacatcacacagcgtccgcaggcaatattgaaaggaacggatacgatatctccttttttgataaattcaacatcacgccccgtttcaatgacttctcccgtaatttcatgcccgagcaccaagccttctggcgccgttgtgcggcctctgaccatatgctggtcgcttccgcaaatgttggttgtaatgactttgagaataacccatgctcacattttcgattcacattcgccttcgggacgccgggcccgtccctcaagattaactccggataaccgatatcctccaccgctacagtccctttgcctttgtacacaaccgctttgtttcctgtcaacgccattcctcccattcatgtgtttggactctccgtccttgaacatgacttcggttcggcatgactctttccctttctcacgactgttttttctgtattcttataacaacaaatatgccaagaaagcagccaataatggttccgccgatgtctaagaagtcgactttacatccatttaacaggaacacagtaatggccgaaaccaggctgatcattactgccagaagaataacccgtttggtgcgcatgtaatccctcctttagattcgtttctaaaacatacccaaaatctctgcaaacttcggttcaacaaaaaaagagacttcacaccagtctctttataattagagatcaattaaaaaatttcctgagaaataatgtgacaatactggttactaacgcaatcgccgtatatataacaacccaaaacatgaatgagctattgcccgaagctaacgtaactaacaatatcaagctcgcgataaggacgatgagcggtgccacccaaaatctcttaaataaaaaatgacccactataccaaatacacctgcgatgatcggaaaaccaaaaacgataaataaaacggcgatggctcccatactaccctccttgccctaaaaccccttcatcacctcaacatcatacagcttcaaatgactcttcggcgtcacgacatcctttaccttcccaatctctttttctttcattttctttccggttttcagactgtactgttcaatgtaggcaggcttgttatacgtgtatgtgaagaaatagaggctgctgcctttttgggtgatttctttgaaatcggctttcattttgtcctgagaaagggtgaaggcgatgtttgtttttcctgtcttggcatcgattttgtgtacctttccgaagccgtcaatgaaatacaggttcccgtcaaaagggaaaaagctgtttttaaagctgaagggcatggagctgtatatcgtttgttcgtcgtttttgtattcggcgatgtcgtgcagctctactttgccgctttttttgttgatcttgaccatttgatagagattgcgggctttttggccgcgaaccatgacatacacagcttgatcgtccacggcaagctgggattcgactgaggctccttcccggtactgccattccgttatcttgtggtaagtgagcttcctttgatctgcttgaatctgaaggagctcatagcctttttcgtcagttgtcgggacaagtgcgtaaatggcgccgtcatggaaaccggaggctcggatgtagtaggagatgacgtcttttttccactcaccgtccatctgccggtacagctctgagcggtatccgtctttctttttgtcgtagccggagttgtataaggtgtaaaagccgtccgtgttttgcagaaagcctgcgctgtcgcctgtgtgctgataggctcttttatgggagcgcaggccgtttttgatcgtataaatcgtgtttttgtcctccagcatcacgctgtcaccgtgaacctttgctgagcccagctcaaggcccttcatcttaaaggaagacagcgtcccgtcctggctgataaacagggcgtagcttttcccgccgccaaatgcatcttgatctgcagaggatgaaaaatacagcaggacttctttgtcttccaggaaatcggggtttctgagatcctgctgacttacggttttatggcttttgagaggagaaatgaagacaaataatgcgattcctgcgagaatcagcatggcgatggtaatcatccactttttcatatccttctccttagtaaatggtcatgatggttgtcgtatacgaagaacttgtgatgtcgcgcggatacacgcctaagcctccgttgctgtctatatcaatgcctgctttcagcaaaaaggcagaccataggagctttgaacagtttttggcgccgtcatggccagtatttctgttattgacgaagttaaatgagtatgggtcgccgacttttgataccgcccagtcggcagcagctgttttttgagatgaggatacgctgacggtttgcacaatggagttgtcttccacgtctctggcattatacgcgatctgcctgacgccgtcgctcgggacagattcaacaattttgtcagaggcggagtacatgccgacgtggccgtgattgtagtaggctgtgtaggagttcgtgtaatagatattgcctttcgcgcttgtcgggagttttttcgtgccggacgacccgcccatgatagacatgccgctttccttggcgagccggtctccctctgctttatcagccgtgatttccttatagaactgttttaggataacgtcctgctttacgtgctgctgtttggcaatctggctggcagatttcatgatttcttccggtgtcgtgcctggctgcagtgcggcgatttcttcagcataatttgtggtctttacggctttggcgggagaaacaaacaggccgccacacattgtaagcgctaccaaaaacatcgacactcgtttcttcaacttcattacatctcctcttttcttgtgagtgtaggaaaggtaatttcctcacccacattatattaggaaaataaggaaagtaactaggttatttacagaatttttagaaatcatttacagaaaaaggcctttatcaggcccttttcgttaaatcttcttgctcatcactacgtctgtttcttgaaatccggtttgctcatatagctttcgcgccgtctgattatgggcaaagacatgaagggacagcttgcggattcccatactgcgtgccgtttgatctaatgccgccaatgcttgctttgcgtagcccttgccgcggtatggtttatataatccgaaatcataaataaacgcttcctgctgcggatgctccggttcagcatgtatccagagccagccaacgatatccttttcattcagcttgaggctccacaaatggtgatggggtgtttccagccctctcggaagcagatcagtaaacgcctgcttagacaaaagctgtgcatcttcaggcagccatgttcccgcttttaccttttctttcgcgtaatgctttgttgtgtatgtgaaataagaccgaaattcttctgtctgcattggggtcagcatgattgtcatatcatctctccttcatatattgactagaggattttacataaaatagaaagaggtgttactatcagaataagcaactgagattgataagtcactagagaaaggagtttcacatgaataagatcgcacccgcagaaatcgctagcatgctcaatgattggtaccttgccatcaagaaacatgaagttgaagaatcctcccgtttatttgaagaagtaaagcctttattggatgacatggaagaggatcaggaggtgctggcctacttctccttattggaactgcgccacaaggttttgcttcacgaggcgagaggacagggctttcagcatgaggagccttctcatatgaatgctacgtctgacatgctgaaatattacttttttctgtttgaaggcatgtatgaggcctataaaaataattatgacattgccattgggctgtataaagatgcagagcagtatctcgacaacattcccgatccgattgaaaaagccgaatttcacctgaaggtcggaaagctctattataagctgggacaaaatattgtgtccctcaatcatacacggcaagcggtcaaaacgttcagggaagagactgattataaaaagaagctggcttcagcactgattaccatgtcaggcaattttacagagatgagccagtttgaagaagctgaggcttatttggacgaagcaattcggatcacgagtgaattagaggatcatttttttgaagcccagcttttgcataacttcggccttcttcatgcgcaaagcggcaaatcagaagaagcggtttcgaaattagaggaggctctacggaacgatgagtatgcccgctccgcctattattatcattctgtctacttgctgatacgagagctgtttaagatcaaaaagaaagaacaggccttatcttattaccaaaaagtgaaggaaaaattgactgctgagccgaatagaatatgtgaggcaaaaatagacattttatatgccatttatgcagaagggggtcatgcggaaacgtttcacttatgcaaacaacatatggatgacttgttgtccgagaaagagtatgacagtgtaagagaactttccattttggctggcgaacggtatagggaacttgagctttacaaagaagctgcccactttttttatgaagcattacagattgaagaactgattaaacgaacggaggttatataaatgaaaagatttctgattggcgcaggcgtcgcagcggtgattttatcaggttggtttattgcggaccatcaaacccattcacaggaaatgaaagtcgctgagaaaatgattggataaatgaaaaacccccgcgggtgcgggggttcaatttaacgaaagaatcctaaaacggtttgtagttttaggattctttcatcttttcagcgtgattgaaaacccttgaagtctaggaagaacgagcattggagcgcagcgaatgtttggaattcgtgagcaccgaagcgcaggcctgacaacgaatgcgagggtttgtcgacacgctgaaaccccgcgggtgcggggttttcttattatagcagcttcttccctagcagggattctacgagctctactgctgttttacctgttttgtttttgtgatcaaggatcgggttaacctcaacgaattcggctgaggtaatgatgcctgcgtcatacagcatttccatagccaaatggctctcccggtagctgatgccgccgacgacaggggttccgacacccggtgcgtcgttcggatcaagtccgtccagatcaaggctcagatggacgccatcacatgctgataaataatcaagggtttcttcaatgacctttgtcatgccaagacggtcgatttcgtgcattgtgtacaccttcatgccgctttccttaatgtacttgcgctccccttcatcaagtgaccgggcgccaatgatgacgacgttttccggtttgattttaggcgcgtagccttcgaggttaaccagtgactcgtggccaatgccgaggctgaccgcgagcggcatgccgtgaatattgcccgatggtgaagtttcaagtgtattcaaatcgccgtgcgcgtcataccagatgacgccgagattatcgtaatgcttcgctgtgcctgccagcgtgccgatcgcaatactgtggtcaccgcccaggacaagcgggaattttttctcttcaatgactttgttgaccttttgcgcgagtttttcatttcccgccaaaacggaattcaggtttttcagttcctcgtcatttttgattttttcgcggttgatcggaatgtcaccgagatcttcaaccgtataccccatgtctgacagccgctcgatcagatgagcgtatcggatggcactcgggcccatatccactccgcgtcgtgcttgtcctaaatccattggcattccaataaccgaaatcgttttatccatctgtgattccacctcaacatttaagataatgtcctatgcgggttctaacaaagatgacttgcggacaacgtttttaaagctctagctgacgattcgcctgctggcgttttttaatgacgacatgataaatgatgtagcaaatgaccataaacggtacaccgcaatacagcgcgatacgctgctccggatcaaatgcgaggctgatgagcacgaccgtatttaatgttaggccgatcagcggaagcaccgggtacagcggtgttttaaatttcaaatcttctatcttcccgccctcacggatatatttgcgtctgaacatgatttgggaaagcgaaatcgcgatccagccgacctgcgcactcatgcccgccaatgataacagtaccatatatacggtttcagccgccgccacttttgagagaagcgacaggcaagccacagccatcgttacaattaacgcgtttagcggcacaccgcgctgatttgttttgccgagcgctttgaaggcctgtccttcattcgccatcgcgtacaggatacgcgttgatgcgtataaacctgaattcgcaacagataacagcgcgattaaaataacaaagttcataatatcagcggcatatgggattccgatttgttcaaatacggctacaaacggactttccacgacacccgcctgtttccacggaatcatgccggcaatgacaatgattgaaagcacaaagaagacaagcgttctccatactgtctgtttgatcgaccgcggaatcgttttttcagggttttcactttctccggccgcaaccccgatcagctcagttccctggaacgcaaagttcacggtaatcatcgttatcaatatggcctttatgccgttcggaaataacccgtcttcataaaaatgtgtcaaaaacggcgcctgctctccgcccttcagatcaatcaggccaaacatggcagctccgccgagaataataaataaaaggataatcaaaattttaatgcccgagaaccagaattcagattccgcaaaggcttttgtggtgatcgcatttaaaataaacatcagtgccgcaaagaccagacaccaaatccatacgtctatatgcggaaaccagcgttgcatcagctgccccgctgataagaattcaatggcgcatgtaaccgcccagccgagccagtacaaccagccgaacgcaaacccgaaagccgggctgataaattttgtcgcataggtctggaaggaccccgacacaggaaaggcgactgccagctctcctaagcagagcatggtcaaaaacatgataaagccgcccactaaataggacagaaccgcgccgagcggtcccgcttggttaatggtaaacccggttccaaggaagaaaccggttccgatcactccgcccaatgaaatcatgaacaaatggcgtgatttcattgtccgctggagctgatttccgttatcttggtttgtattcactttctgcaccccttcagcaacttgtattggatctaagctggaacatctgcatggtgctatcccagtttgctgtccaaagagtctctatctatttaatataaaattcacttcttctcataaagatacattatactaaaatactgtagctgagcaaatagggagtgctgatttttctgttgtaaatttatacaaacgaagtgaatatcccgccatggtgcggatttatgcgttttgcagcacgtgcttaattttctctattgcccaatccaaatcctctttggaaatgattaatggcggtgcaaaacgaatgactgtatcatgcgtttccttgcataaaagcccttcttccttcaaacgctcacaatacggacgtgccgcttcagtcaattccacaccgataaacagccctctgccgcggacttctttaataaccgggttgtcaatgctctcaagctcgcttttaaagtattctccaagctcaagagaacgatccgccagcttttcatcctccagcacttctaatgaagcgatagacactgcacatgcaagcgggtttccgccaaatgttgagccgtgtgagccagggttaaacacgcctaggatctcgcggtccgccgcaatgcatgagatcgggaacacaccgccgccaagcgctttgcccaaaatatacatatcagggacaatgccgtcccagtcacaggcaaacgtcttgcctgtacgtccgagacccgtttgaatttcatccgcaataaacaagacattctcttccttacaaatcgccgccgcttcctgtaaaaatccttcaggcggaatcacaatgcccgcttcgccttgaatcggttcaaacaagaatgccgctgtattcggcgtaatggcctgtcgaagcgcttccacatcgccgtaaggaatgagtttgattcccggaagcatcgggccgaatcctcgtttatattcctcttcagaagaaagagataccgccagcatcgtgcggccgtggaagttcccgacacatgcgataatttccgcttgattgtcagctacgcccttcacttcatacgcccagcgtctcgccgctttcaccgcggattcaaccgcttcggctcctgtattcatcggcagaatcatctctttgcctgtcagtttagctgttttttcgtaaaacggcccaagctgatcgttatgaaacgcgcgtgacgtgagggtgattttatcagcctgatcctttaatgcctgaatgattttcgggtgtctgtgcccctggtttaccgcagaataagcactcagcatatccatatattcattgccttccgggtcctttacccaagaacccagcgcttcagaaataacaatcgggagcggatgataattgttggctccgtaatgagacgtctgatcaataatttctttggatttagataaagctgacatatttgaattcccccttgttttctgtttcaacatgttatcctgctttccctttatataaatgcaagttctgtgccaaatcaagaattcgtgtgttttctacaattttcgaggacaaggtgcaaaaacattctgatatttcgagcaaaaattccagcaagtgcaaaattcttttgcatatcctctccatttttttataaaatagaagcaatattaagaaaactgagggaggttcatacagtggtcaaagacagcgaattcctcacattggtttttcagagcattttagatgaaatcgatgttggcctgcacgtggtagacgagcatggaaacacaatcgtttataacaataaaatgatgcagattgaagatatggagaagcatgacgtcttgaataaaaacctgatggatgtgtttatgttttcaaagcagcaggacagcacactggtacaggctcttcaggaaggaaagacgattaaaaacgtcaaacagagctatttcaataataaaggccaggaaattacgacgatcaatcatacatatcccatcgtccaagacggcaaaatcaagggcgccgttgaaattgccaaggatgtgacaaagcttgaacggctgatcagggagaatatgaacaaaaaaggcagcacaacctatacgtttgacagtattctcggcaccagtccggccattcaagacgtcatcgaaaacgccaagcgggcaacccgtacgtcatcatctgtccttctcgcaggcgaaaccggcacgggaaaagaactgttcgcgcaaagtatccataatggaagcgatcgttctggcggcccgtttatttcgcaaaactgtgcggcactgccagacagccttgtggaaagcattttgtttgggacgaaaaaaggcgcgtttaccggcgctgtcgaccagcccggcctgtttgaacaagcccacggcggcacgctgctgttagatgaaatcaactcgctgaatctcagccttcaggcgaagctgctgcgcgcccttcaagaacggaaaatcaggcgcatcggttcgacaaaggatacaccgattgacgtacgtattattgccacgatgaatgaagacccaattgatgcaattgcaggcgaacgaatgcggaaggacttgtattacaggctgagtgtcgtcacactgatcatcccgccgcttcgggaacgaaaagaagacattttgcttctcgcgtcggagttcatccagaaaaacaaccatctgttccaaatgaatgttgaacacatcagcgatgacgtgaagcaatttttcctttcttatgactggccgggaaatattcgcgagcttgagcatatgatcgaaggcgcaatgaatttcatgacggacgagcaaacgattacggcttcccatctgccctatcaataccgaatgaaaatcaagccggctgacatcccagagcctgaaacaccaagacaccagccggccgcggacttaaaagaaaaaatggaaagcttcgaaaaatatgtgatagagaacgtgttaagaaaacacggccataacatctcgaaagctgctcaggagcttggcatcagcagacaaagcctccaatatcggctgaagaaattttctcactcgtctaacgaataatccggagcaggaagcctgatcagaaaaacagtgcctctgccgatttcacttttcacttcaatcgtcccattgtgattgtcgataatcgatttcgttatagcaaggcctaatcccgaacctccatatttccgggagcgggatgggtctgccctgtaaaaccggtcaaataaatgcggcaaatgctccggcgcgatgcctgtgccattgtctgctatcatcagcatcacgccggaactgcctttttgcagagaaatggtgatggcaccggttctctcatttgtatactgcaccgcgttataaaccaaattcagaatgacctgtttcatcttatcccggtcaaacaccgctttagcgtcatcctcaagcagcagctgcagccttctttctttcgcaagcagactgagctgcggctccatctcccttatgagcgcatcgagatttcctctcttcatttcaaagctcggcacccgatcaatttttgctaaaaacaacagatcctctatcagccgagtggctctcttcgactcttcatacatactattcagcgccctatctctctgctccggctgaagcgcggcgccacgcagcagcacttcgataaagccgtgtatggacgttaaaggcgttctcaattcatgtgaagcgtctgatacaaattgccggatgcgctccttcgcttctttttcagctttaaatgacgtttcaatccgctccagcatgcgattaaacgaaatagcgagcgtgtcgatttccatttgttttcgatatacaggaagccttttattcaaatttcctgcattgatttctcccatcatatgtaccatttgtgataacggtttaagcgtatgtctgaccacaggcaagaacgtgaaaagcccgagcaggagcgcaaccagcgagagcgtggaataaatgctgatttgccggagcagtacgtccttcagtggttctgttaaagtactcatttggatcacgcctgcttcttttccatcaatagtaatagcctgaaacacaatcagcacttcctcgccggattcatttttcgtgattttgtaatgcaaggccatcgtatcttttaatgcctcatcatatacactttttttcactgttggcggtgctcccgcatatggatcggtcgacaataccgtactgtcttttgttttcttatcgataaaaacaatggtcacgcccggatagataaaggcgggacggacagcaccatctgacttttccgagctgtcgggatggcttttgtatgttttaatattattccagatggttggctccgttgagttgatataactttgaatgctgacagctcggttttcatataagaggcgttttccaaacacatattgcatagcgccgacaaacaccaatagaagaacgagaatgcataatgaacggaataaaagctgaaagcgcagtgttttgaatcgttttttcattcaatatccacccgatagcccgcaccccgaaccgttcggatcacttcatgctttttgtcattcaatttttcccgcaaggaacgaatgtacacttcaacaatattctcttctccataaaaatcatacccccatactttatccagaatccttgctttactgagcacaaggccgtgattcagcaccaaaaactttaaaagctcgtattctgttgctgaaagcttgagcacctcttcctgatagcggatttctctgcgccgatcatcaattcgaaacggaccgagcgcgaattcttcaaacaggttgggaaagtgatcccgaattctcgcatagattcgcgccagcagctcttcaaagctgaagggtttgatcatataatcatcagcgccctctgtcagcgcttttacccgaacccccacctcatccttggccgtaagcataataaccgcggtatggccggttttttttatcatttttgatacttccagtccatccattccgggcatcatcacatccaagatggccacatgcggctgaaatgtctttacggtgttcatcgctgtcattccatcagctgctgtcttcacttcaaagccttcattttcaagacccattgtcaaaaaatctaatatcgccggttcatcgtccacgagcaaaatcttgatgcctttcatcctattcatgctgtgctctctccttagttggcataaacctctgattagttttttcccttcccctcctattattcgtttttaactgaaaacaaactgaatcttccctaaaaatcagctgaattcagcaagttttcagccagccctcatttgattttcagcttcggcctatacaattgccttagttggtacagccaacaatgaaataaaggaggaatctcacatgaatatcactaaagttttatcaggagctgcactgggaacgattatttcaatcagttctttcacttctgctcacgccgctgtcattcaaaaggatgatacatcaacgaaggttgagacgaagcaacaggcttccatcacaatagcaaaggcaaaacaggttgctttgaacaaatgcaaaggtactgttcaaacggcccaaatgaagaaagtgaatggcacatacgtatatgttgtgaaagttctcggtgaggacggcaaacagcatacgatgaacgtcaactgcaacagcggcaaagttgtgaaacatgatgttcaaaagaaacaaagctatatcagcaaaacaaaagcccaatcgatcgctttgaaaaactgcaaaggtgcggttcaatcttctgagctgaagcaagaaaacggtgtttacgcttacgtcgtgaaagtaatgggtgaagacggaagccttcacacgctccatatcaatggagaaaacggcaaagtcgcaaaacacgagcaaaagaaacaagcacatctttctaaaacaaaagcgcatcaaatcgcactcaacaaatgcaaaggcgcagttcaatcttctgaactgaagaaagaaaacggcgcatacatctacgttgtcaaagtgcttggcgaagatggaaaaactcataaaattcatgtcaactgtgacagcggtaaaatcgtaaaacaagaagtgcaaaagaaaaacgcagccgttacaaaaacaaaagcacatcaaattgcactaaataaatgtaaaggcacagtgaaatctactgatttgaagaaagaaaacggcacattcgtttacgtgtttaaaatcactgcccaaaaccacactgaacatacagtgaaagtgaacgctgaaaacggaagcatttgcaaataaaataactgcttgccagcagtaaaataactgaaattcaacgtataacaccagtcttgttttaacacaaagttctaagttcatgtctacctttttctaaatactcttttaaactgaacgtgtgtgacccgcgttcagttctttttctaaggaggacctacaaatgaatatgaaaatatgttctgcagctgctttaggcgcggtcatttcaatcagttctttatcatccgcacacgcggctgttctgcataaagaagacactgctaaagttcaaacccagcagcaggcttctattacgctctctaaagcaaaaactgtcgctataaagaactgcaaaggcgcagttcaatcagcacaaatgaagaaagcagatggcgtttatgtctatgtcattaaagtgcttggtgaggatggcaaaattcacacctttaacattaactgcagcagcggaaaaatcgtcaagcatcacgttgaaaataaacaagccgcgatcacaaaagcaaaagcacaaagcattgcgttgaacaaatgcaaaggcaccgtcacatcttctgcattgaagaaagaaaatggcacctatgtgtacatcatcaccatcacagccagcaaccacacggtacaaaccattaaagtccatgcagagaacggaagtatttacagctaactgctatttgctgtttcacgtgtaacatccatcttgtatttttcttcatattcgatatatccttttcaactgaacgggcgtgacccccgttcagtttttttgcatatcaaaacagcctggcaaacgatgccagactgttttgattaacttcctaattggtctgcggacgacagcttgatgtcaacagatttttcttttccgccgcggtaaaacttcaccttcacccggtcaccgacttttttctgataaagccgttttcgcaggtcaacaatatcatttactttgtaaccgtcaaattccgtgatgacatcgagttccttcagtcccgcttttccggcaggtgaaaaggcgtctacacccatcacaaccgctccattggtgacgttcttaggaagctttaatgtttcatcccaatgatagcttgcgatgtcgcttagggatttcatctcaatgccaaggaacgggcgtttgacctttccgtatctctctaaatcctctatcacagggatcacgagcttagacggaatggacaggccaatcccttcaaccgctgactcggcaattttcattgaattgatgccaatgaccttcccatccatatttaacaaagcgccgccgctgttcccagggttaatggccgcatctgtttgcaggacttctgcgttccagtcaggctgtccatcaccgtttgaatctactgggatcgccctctccgtacccgagatgacgccttgtgtgacagagccagcaaactcaaggcctaacgggttcccgatcgcaataaccggctccccagacttcactttatctgaatttccgaaatcggcgactgctttaattttatcgcttttcacccgtaaaacggcaagatccatcagctggtcgctgccgacaagatcagctgatacacgcgatccgtctttcaagctgatttcaatttgggaagcgccttcgatgacatgatggttggtcacgacataagcggaatggtcatttttcttatagatgacgccagagccgctcccagcctcgccgctctctccccgtatatctgatttttggatgttcacaacaccgacaacggcgggcgacacattgctgacaatcttggtgaccgtattgttgacactgacattcaccgtcctgattgattcccggccgttattgttccgctgctgatctaaagcgcccgtatccagcccttcatttgaaaggtacggcatgataaacgccattaatacggcaccgacaatcacaccaatcaggcttgaaagaaaatatccttttttgcttctctttggctgttcaggagtagtatgttcttcctcacgttcgtaatccaccatattccatcctttccaagaacgttaatatggttatattgtgggttagaagctcctagaatagtcatgatttacatagaaaaattatacagcgcaaagcggagtggccttcttcggatcagtgtcgtataagtcaaatgtctcacccgtcataaatcctttagaagccaatgtctgctgcacagacattcttgccagctccttcatgttgttgtcctggctcaaatgcgccaggtaaatacgagacgtctcatcgccaatgacatccgtcatcgccaaggcagcatcttcatttgacacgtgcccgacgtcacttaaaatccgccgcttaatgctccatgggtatcttcccatttgcagcataccgacatcgtgattgctttcaaacacaaacacattcgctgaacggataatgcctttcattcggtcgctgacatatcccgtatctgtcattaacgcgagctttcggccgttataatgaaacacataaaacatcggttcggccgcatcgtgggagacgccaaacgattcaacatcaagtccgccgaacgactttaccgtctccatcggaaatacaaacttttgatcggtgtcaattttgccgatttgattctccatcgctttccaagtcttctcgttcgcatagatcggaagcttgtactttctggcgacgacaccaaggcccttaatatggtcactatgctcatgcgtcacaaaaatgccgtctacatcatccagcttacgcccgatctgcgccatcagcccatccatggctttcccgctcaaaccggcgtccactaaaaatgcgtgatcctctgtttcgaggtaaaacgcatttcccgtactcccgctcgcaagtacgctaaattgcaagctcatgtttgtctcactccattattttcattgatctgtatctaaaatcgtactctccaaagcattcacagtaaaatactcttgtactgtctttttctcaccgttcacttttttctcgtactcgaccgtaattctccataccggcgccagcacctgcgtacttgtcagcggatattgtgctacatagccgaatttacagctcttcacagtgctgtattcttttaattgattttgatagtacaatagctcaaccgcatccatttcagtaattaagctttctttctggatttgcttgaaggtctcaagcgtagtctggtcgtatgacacaacctcgtttttaccgtttaagtgcagcaccacttgcccgatcatattagagggattgtcggtcttttggtaaatataatgaccttcgtacgtttggaagaaaataatttctttcttcgatttatcaaccttccaaagcttatatttttcgccatcttgaattttcgaagaaacaagtgcctgagcatcgtcctcgatatccttctttgatagggcgattggatttgcaaacttcattttcaggctcgttactttatgatcatcactaggcatgtccattaaaggcttttgatccttcagcgcctcaatttcctccttggagaaagacttttgatttgccgtgatccgataaccttctgtcgcttccttattcaaaccttcatacgtgatatgatcggccttcatgtcatgctcgacatcatttttaatgacttcatattctttgccggtagcctgccatttttgaaaaaactgatagcctaagaaaatatctaaaatgaggaaggcaacgatgaagattgattttgtcttattccactccactgttagccccctccttcctcaataaatcctttgtaatcggcacaatttttccatttactttcatcgcccaaaccggttccagttcaacgagaggatcatcgttggttgatgttgataccaattgataagcaaggaagatctgatcaattttgtccgtatcataagcggtttgtttcgaaagcagcatcctcacttcgctgccgctcatgagctctgtttcacttgttttaatcggattcgttccgagactgtaattcggccgcttatagctgagaatatcatcattcgcccattgcaccgtaatcgccgatgtcgctccgaaaggtttggcggtgctgttaatgaccgggatctgatccataaagatatagaaactcagctgctggctgtcattgatactgaaaaattgatagtgatccgtccagcttccggtatcctcaaggtatttttggctctttttgattaactcacctgtttgataggatgtgctctgcaccaaattgcgctgctggaattgcacctgtcgctggcttagattcacatctaaacggctgatcccatctgtcagcacatttctgttgttgtaattcgaatcttcccttacgatgctcggatcgctaaacaaagcctgcttaaaggtatttgttttaatcgattcagtgacaaattcttttttgtccatcgtaagcggtttgtttggcagcaaaaactctttctttgagccaatggagaacaaactgaacgccggcatatttgattgcctgtttttcaagtcgttcataatgttccggtagtttgccgattcaaccgtcacttcaagaatgagctgtttgctgtaagacaccaaatagatcttcttgttcgcttttgtttcattgaacgggatcagaatatggtcaaacgaactgtattcaaacgactgattagaccatttaaacagcgtttggaaaatatcaatcggaatcgtatcgctgaattgcaagtcaagcttggcttcagaaccgcctattccataaaaccagctcttgaatccagacttgtcatactgatccgaaatatctttaattccttttacatcccaatgcggcaagtcagaccagatttcttcatagagggcattgtcatccactttgtaatgagcgccgtcatcatggataaacatgtccctcggccttaccgtttcagacagcttttgggtcgttttttcgattttgtgtttctcacgcacagtagactctgttgaggatgagccttcagaaaagtttggctggaacgtccatatcccccatgtaaaaacaagactgatgacgacgagtaccgtaagtaatatcgtttttatattttcacgcttcatcccaatcatcctcttgttcctctttatatggaagagtaaatgtaatcgtcgtgccttttccttctatgctgtccgcccaaatatctccgccgtgcgcctgtaccatttccttggcaatcgccaatcccagaccggtgccgccaagctttctcgttctcgctttatccaccctgtagaagcggtcaaagactttttcgacatcttttttcggaataccaatcccttcatccttcacgctgatatagagaagttcttccccttcattgacatcaatcgagaacgtgacatgtccgccttccggtgaatattttaaagcgttagaaataatattatcgagcacctgcgttattttatcctggtcaatctcgacgtacagatctctgtccggcagattgcggataaactccacatgctgctcttttgtcatttcaaaacggtcaataataagcgacataaaccggacaatctgaatccattcccggttaaattgataatccttgctgtcaaatttcgacagctgaagcagatcattgacaagccggatcatacgctctgtttcattttgcgtcaccattaagaagcggggagcaatgtctttattttcccacgcgccttcagctaacgcttctaaatagctgcgcattgtcgtaagcggcgtccgcagctcatgtgatacattcgcaacgaattctctgcgttcctgatccattttctcttgttcggttacatcgtaaatgacagcgattaaaccatcaattttgccgtgttccctttgaatcacagagaaattcacgcgaagcaccgttaattcatcatcgcgctcaatttcaagcagcatagaatcctgctgctccactaaatcttcaaaagtataattctcttgaagccccagcaaactcgtaatcggcatttctaaggctgtttcacgtgaaacgttcaacagttccagcgccgggctgtttaagagaataatcgctccgtttcggtttgtggcgataacgccgtctgtcatataagcaatgacagaggctagctttctgcgttctccttcagtcatcgcctgggcatcttcaagctctctcgttaagtggttaaacgttgtggctagctgcccaatttcatcatgcccgtactttttaaccttcctcgagaaattccctttcgcaagctccatcgcctgctttcgcatatctgaaagcgggtgggtaatggttcttgccagaaaaataccgagaagagccgtcaaaacaagtgccaaacctgtgccggacgccagtatcgtgttgatcgtcttcatttgattaaagacatcttccatactcgcgacaacatagatcgcgcccacaacctcttggttttcagtcatgacgggcttcgcggaaataagaactctgattttgcttttcgggtcataatattttcttaaatacgactgtttggtagaaaaaattcttttaaaaatcagatcggtcgtttgtttcccagctacttcctcaccgtacggctttgaagaaccgaccacttcatagcttttatctacaaagctaatttcccgaacctcatcacttttcgtgaagtcattcaaaatacggctgacgtcatcctttatgacggtactgtcgttatcgctcttatattcttgttcgatataataagaaaggttgtcgattcgctgattcaacgattgttcataagagctgatcagcgacttctctacctgattgacaaaatacacaccaatgatttgcatggcaatgataatcaaaagcacataaatcaaggtaatcttaaattggatcgaccgaaaaaaaccaaccttattcatatgggcattagtcctgttctgggtttctcaagtaataacctacaccgcggcgtgtgacgatccaatttggatggctcgggttgtcctcgattttttcacgaagccggcggactgttacgtcaaccgttctgacatcgccgaagtaatcatagccccaaacggtttgaagcaaatgttcacgggtcatcacttgtccgatatgttttgctaaataatgaagcaattcgaactcacgatgagtcaattcgattgtttcatctcgttttgatacaacgtacgcgtcagggaagatgacgagagagccgatatgaatctcgttagaggaaggctcttcctccgcaggcgctgttgtcagctggcggcgcaggttcgcttttacacgtgccaagagctcacgtgtgctgaatggttttgtgacatagtcatcagcaccgatttcaagcccgataaccttgtcaatttctgaatccttagccgtcagcataatgattggcatatcgtatttctttctgacttcgcggcatacttcaacgccgtctttattcgggagcataatatctaaaagaattaaatcaggctgaagctcttctaccatttcaacggcttcgtttccgtcgtgggcacagtgcacttcatagccttcttttcttaagttaaattccaatatatctgcaatcggtttttcatcatctactacaaggatctttttatccatcattttgattttcctcctgccgaatgacttcatttcatctatataacattcgtttcatcacttatggcccatgtaaagaatgggtccttgtctattataacggtttaaggtcaaaagataaaaaaaataaaggtttagaaaaaaaacacatgtttcacctttatcgccagttgtttatctattgtcatgctggtcaactttttttaaaaaagataactttattgaaacctcctctcaccggagtgcgtctttatcaatgacgtcttcttctttgaaccggccgaagggccggttctccctttttcttctattataacactcctcatgtttgcctttttcctaaaagaaaaaacgcacctacgattgcagatgcgtttggtaagtggctcgggacggaatcgaaccgccgacacacggattttcagtccgttgctctaccaactgagctaccgagccaaatgttttatttttctctactaagtaaagtaaaatggcggtccggacgggactcgaacccgcgacctcctgcgtgacaggcaggcattctaaccaactgaactaccggaccttacagtaattgcccggagagctgtcgtgtcagctctcacagacaaataaggaatttagcaataacgctaaagtaaatcaatgacccgtacgggattcgaacccgtgttaccgccgtgaaagggcggtgtcttaaccgcttgaccaacgggccttcacgaaatggtgagccatgaaggactcgaaccttcgaccctctgattaaaagtcagatgctctaccaactgagctaatggctcttaaagatgtcggaatttctatagagcaaacgacttagatctagttcttatcttgtactctattgaagcagtttccgtaacaacgagatttataatatcacgaacaaatagaagtggcaataacttttttggttttttttcatatttttttctcagaccaacttatatgcggctttcaaacaaaaaacaagcccctgatataggggcttgcagacatattctatttagttcgcacggtacacactgcgaaggacatttgtttgtgagcggtctggaccgacagagaaaatagaaagcggaatgcctgtcagctgagacacgcgctcaagataatggcgcgcattttccggaagctcgctcaagctcttcgcacctgtaatatcctcagtccagcctggcatttcttcataaaccggctcacattcagcaagtgccttaagacttgctgggaattcttcaatgatttcccctttgtagcggtacgccacacagattttcaacgtttcaattcctgttaggacgtcaattgagttcagagaaagatctgtaattccgctcacacggcgggcgtggcggacaacaacgctgtcaaaccagccgacacggcgcgggcggcctgttgttgttccatattcgcgtccgacttcacggatttgatcgccgatttcatctttcagctcagtcgggaaaggaccgtcgccgacacgagtcgtatatgcttttgatacaccgacaacgtgcttgattttggtcgggccgacaccagaaccgatcgtgacaccgccggcaaccgggttagatgacgtaacaaacgggtatgttccttggtcgatatcgagcataaccccttgtgcgccttcaaataatacacggcgcccttcatcaagagcatcgtttaagacaacagatgtatcgcaaacatattttttaatctgctggccgtattcataatattcgtctaagatatcctcaagtttaaacccttctgtctcgtacattttctcgagaagacggtttttttcttcaagattgcgctcaagcttttccgcaaacgcgtcacggtctaacagatccgcgatgcgaattccgatgcgggctgctttatccatgtaagcagggccgattccttttttcgttgtgccgatcttgttagcccctttacgctcttcttccacttcatccaatttcaaatgatacggcagaatgacgtgagctctgttgctgattctcagattatctgtactcacgttgcgctcatgaagatacgcaagctctgtgactaatgctttcggatctacaaccattccgtttccgattacacacgttttatccttatagaaaattccagacgggattaagtgaagcttatatgtgattccgtcaaacttgattgtatgccctgcgttatttccgccttgataacgggcgatcacttctgcattttctgataggaaatctgtaattttaccttttccttcatcgccccattgcgtacctactacaactactgaagacatgtccgtgcacctccgttaacctttcaaaacgattctattcaaacaaatcaagtttatcagtgaagaaacagaaagtcaattgtaaatccgaacattaaattattcaaaatctatattcgttcgcttccattcgttttataagcgttttctcactgttttgtcataaaaagcttgcgaaactttcatcctttagcataagaaagaatcacttgcctgatatcccttttgaattcataaaaacgacccgccagccgtccgggtcctctatcgtcacgcccccattgctccagtacgggttctctgattcgacctcttgatagcccatatgctttagctttgaagtgatcgctgccagttcatctgcattcggcacataaaaaacaagaaggctgtcgggatggggaacgggagcagtgcttcccccttcatactgggtgaattccaaatgataatcggcatgaggaaggccgaacatgacaccgtcatacccgttatgctttgaaaattctcctattcgtttcaaacacagtccctcttcgtaaaaacgaataatctcatcaagctgacccgtaggacgtgcaattcggacttgtgctgcgtgaaaagacgaaaaacgttttcccatattgttaccatctcctttttgcaccattttattaaaacgctttcaaattatcatccgctgagcgaacggtatttcttccatctttcgaatgaaaaaaccccaagagcagctcttggggcttatgcgccgggcggaacgcctgcgtcatcaaaacgccgttccaggttgacgaatttgttgtattcttttacgaacgcaagagacacggttcccaccgggccgttacgctgtttggcgataataatttcgataatatttttattctcggtttctttgtcatagtagtcatcacgataaaggaacgcgacaatatccgcgtcctgctcgatacttcctgattcccggatatcagacatcatcggacgtttatcctgacgctgctcaacacccctggaaagctgagaaagcgcgataacagggacttgcagctccctggcaatcgacttcagttcacgggaaatttcagatacttcctgctgacggttgtcctttgaacgaccgcttccctgaatcaattgcaggtaatcgatcaaaatcatgcccagcccgctttcctgcttcaagcggcggcacttggcacggatttcactcactcgaatacccggtgtatcgtcgatgtaaatcccgctgttcgacaggcttcccattgccatcgtcagcttgccccaatcctcttcggtcaggttacctgtacggagattctgggcattgatatttccctcggcacaaagcatacgcataacgagctgctctgcacccatctcaagactgaaaatcgctacgctctcatcggtcttcgtcgccacgttttgtgcgatgttcagggcaaaggctgttttccctactgaaggacgggcagccacaatgatcaagtcgttgcgctggaaacccgcagtcatccggtcaagctccgtaaaccctgttggaattcccgtgatatcaccttttcgattgtgaagctgttcgatattatcataggtctggacaaggacgtccttaatattttggaaggcactcgtgtttttgcgctgtgccacttccataatcgttttttccgcttcactgagtaaatcctctacctcatcctcacgggtatacccgtcttgagcaatcgttgtcgcagttctgattaatcggcgaagaatcgatttttcctcaacgattttcgcgtaatattctatgttagccgctgtcggcaccgagtttgcgatatctgtcaaatatgaaatgccgcctacttcttccagcaggtctgtgttcgcaagctctgatgtgactgtcaccagatcaaccggttcacctcggtctccgagcaccagcatcgcattatagattttttggtgggacattctatagaaatcatctggaatcaatacttctgaagccagtgttaaagcagacggctgtaaaaaaatagcgcctaacacggcttgttcggcttctatattttgcggaggaagccggtcattcagaaggtctgtcatgctaagcaccgtcctctcattaaaaaatctccaacctccattctaccatttctacagaaaaaaaatagaaaaattgtctgtttcctgtttttttcagttagcagattggatcgtttcggacagtaacaaggcgggaaaaatgcaataaaacatgagggaggaatgaaagatgataaagaaatatgcgattacgcctaatgttgatgcggacggctggtttattgaggtggagaatgtagcgccgacagctttgtatacgtctaaagacgccgctattgaaaaggccaaacaggtggctaaggaaaacagtccgtctaagcttgtaatttatgaccagtttaaaaatgtggaagaagaacactcattttaatgaatgaaagccttcgctgcagcgagggttttttagcggttatcggtttatttcatccattggatgcctatgtgcatcatcaaatctgccgctttttgatacagatcccactccccgatcgaagcaaatttccccatcagctcctgaagctttagcctcactgctatatattcttcgaaagtgacagctttttcagtgtctatttggtgttccttcagcatttgttttaataaggataacggtgcgtgcataagaaccctccttacctcttttataacggtcattttccgattgctctattcctttgtgacatcttcttacatttcacagctgattcttgtacaatggacagaagagaggagggatcttttgtgagacctttgcaaatttctgctgaaactgcacaaaagcttgcagagtccttgaatctgccgcttgaacagatcatgcatatgcctcagcatattctgcttgccaaaatggctgaactgcaaaaagaggacaaatcatagccttcattcacatacttgcttacctgtttcgggataatatcatgtatatgttagaaaagaggagtaactgctttgccacatccacataataaaaaaatccaatcattttggctgatcaccggcattatctttatcgcctttaacttacggcccgcgatcacttcagtgggtccggtcatcagctctatccgggcagagctgcacatgtccaatggggcagccggtttttgaccgcactgccgctgctttcgtttgcagttctttctccacttgcacctaagcttggacagcgcctcggaaatgagcgaactttatggctaggtctcgtgatactgcttatcggcgttttgactcgttctaccggctatactgcagctttgtttttcggaacggcacttatcggcgtcgggattgcgattggtaacgtacttttgccaagcttaatcaaacataaataccctgaaaagccagggatcatgatcagcctgtatacgacatcaatgaatatattcgcagctttagcatcaggtgtcagcgttcctttagcgacccagatgaatggcggatggaaacaggcttttctcttatggggcgggctggctttacttgcattgctaatctggatacctcagctgcgccatcgagatacggcaaaccagacaatgaagctgcaatccagttccatttgggcttccaaaatggcatggtatgtcaccatctttatgggcctgcaatcgtttttattttacagcagcatcgcttggtttcctgaaattctccgttcacacggaattgatacggcaacagccggatggatggtatcactcatgcaatttgcgagtctgccttccacttttctgacaccagttttagctgaccgtgtgaaacagcagcgcggtatcgttgcggcgctggcctcagtttatctgatcggcctttgcggattattagcgggcggaagccatacattgcttgccatctggatgatcattatcggtatcggacaaggctccagcattagtctggcgctcactttgattggtctccgcagtgaaaatgcccaacaggccgctgcgctgtcaggcatgtctcagtcattcggctacctgctggcagcagtcgggccaatctttgtcggctatctctttgaccagacgcattcttggacgatgcctattgtgcttctcattgctgccctgatcgtaatgggagcagccggacagggagccggacgagatcgatacattttccagtcagaaaaacaaagaaattcagcataaagcggggaagatatctccgcttttttctttgaatatttatggtttattcataagtttttcatatttgttttttacaatgagacaccataaagaggtgaaaaacgatgaaaaccaaacgattcgacgcagcccttattcttattttgctggcagcagcttttttgaatacgtatcacatttggcaggatgatacagcaaaccagtactatttggcggctgtaaaaagcatgacgcaaagcttccataacttcttttatgcgtcatttgacccttctggatttgtgacagtagataagcctcctgtcgtgttatggattcaaacgattttcgcactgattttcggtgttcacacgtggagtgtcatcattccccaggctcttgccggagttggatctgtcttccttctctacagaatgatcaagccgacttttggaattggagcggcccgcatttccgcacttgttatggcactgacccctatcgcagtagctgtcagccggacaaacaatattgacagcatgcttgtctttaccttactgctcggttcagcttgcctgcttcgggcagtaaaacaaggcaagctggtttggctgctgacggcatttgccctaattgggctcgcctttaatatgaagatgatgcaagcgtttatggtattgcctgcatttgtgttattctacctggttgcatatcgggtttctctgaagaaaaaaatcgggtccctgcttctgtctcttgtccttctgacaggcctttcactctcatgggcgattgcagtggattcagcctcttcctcaagccggccttatgtaggaagcagccagaccaactcagtgctagaactggcctttggctacaacggcacagagcgtctgcttgggcaaactacgggcctggcaaagggtgatatgaatgctgctggcggagggaagatgcagaatcaagacaacatgcaagcgccaaatggcaacggttcatctttttctcagaacggaaatcaatcattcggaaaccattcacaggcgcctcagccgcctaacggacaaaccggcgctctcaatggaggcggaggtacacctcccacaggtggcaacggacctggaaatggagggcctggcggtggaggcggaaaaagcgtgaatatgttcggcaccggtgatcctggaccgcttcgtctcttccaatcagcactttccggccaaatcagctggatgcttccattctcattgatcggattactgggcgcaatcgtcagctggtaccgtgatcgccgcggacatgctgctaaaatgaaagaaacgctattctgggcggcttggcttgttcccgtggctggtttcttcagcatcgcaggattcttccaccagtattatttgattatgctggcaccgccgattgccgccctttctggtatcggatggtatacgatgcaccgcttatacaaaaataatcaagactggtccagctatcttctgccggcagccgttctgatcacagccgccttccaggtgtatattctgagtgcttatacaagccaaatcggcagtgtgtggatgtatgtcctgggactcgtaggacttggcatcacccttgcacttctgatgcttaaacgcagccatacgttcagtaagcagctgaccatcatcagcttgtacgttctgcttctcacacctgtttactggtcagcaacgccgcttctatacggtggcaacagcgtccttcctgaatccggcccgcagctcaaaggctcagcaaacggcgggaacatgttctcttcagaggtcgacagcgggctcctgtcctatctgagaaaacacaataccggcgaagaatatttatttgctactttgacaaccgtaacagctgcgccatacatcatttccgaaaatgaatctgttatggcaatgggcggatttaacggcacggatcccattctgactgtgtcggaactaaaaaaactgatcaaagaaggcaaagtgaaatacttccttctgtcagaaaacaactcaggcaacagcgaacttgtttcctggattaagaaaaacggaaaagaaataacatctgacgagtacagcggttcctctagcagcacaaacagcgtgcagggaatgcgaggaggacctggcggagaaagccagcaaactctttatctcgtggaataaaaaaaagaggcttggatgaatccaagcctcttttcaattaagcttcttcttttacatgtacctttaacacagcctgcacttcaggatgcagcttcacaggcacgttcgtatatcctaatgcacgaatgccgtccggcagttcaagcttccgcttatctactttaatgttatggtctttttggagctgttcagtaatttgcttgcttgtcactgaaccaaataaacggccgccctcacctgattttgcgctaagctcaacagtcagtttttctaatgtctctttcaagctattagcctgctcaagctcagcaatggcttcttttttctctttctgcttttgtccgtttagcgcgctgatgtttgaagcgttcgcttcaaccgcgaggccttttttaattagaaagttatgcgcataaccgtctgctacgtttttgacttcgcctttttttccttttccttttacatcttgtaagaaaataaccttcatctctgtacgcctccctcaaaatactcatctatggcgtgcttcagccgttccagcgcttcagaaattgaaatgccggacaactgagtcgccgcatttgttaaatgccctccgccttccagggcctccatgatgatttgaacatttacctcgccaagcgaccgcgcactgatacaaaccgtttgttcatcccttctcgccaccgcaaatgaagcctcaacctcactcatcgacagcagcgaatcggcagcctgcgcaatcagcacttgatcgaagtattcctcttcattttcaggaagagaagcaatcgcaatgttatctttatagaggaccgtatgctggatcagcttcgcccgtttaatataggaatcaacggtttctttcaggaacttctgcaccagcaccgtgtcggctccttttgcccttaaataagaagccgcatcaaaagtccgcgagcccgtgcggagagaaaagctctttgtatccactattataccagctaatagggctgttgcttcaatcatattgatttttaaacgcttcggctgatattcaagcagctctgtcaccaattccgctgtggaagaagcgtatggttccatataaacaagcagcggatctctgataaactcctcacctcttcggtgatggtcgatgaccacgatatgttcaattttattgaccagccgttcctccatgacgagtgacggcttatgtgtatcaacgatcacaagcagtgtgtcatcattggaaatctccattgcttcttcaggcgtaataaatcttgaccacagttcttcatattttttgatttccccaatcaaacgctgcacacttgatccgatttggtttgggtcaatcacgataaaaccatctttgttatttgcctgagccacctttaaaatcccgatcgctgcgccgatagaatccatgtcggggaatttatgccccatgataatcacattgctgctttcggtgacgatttcctttaaggcgtgagaaatcacgcgggcccgcacccttgttcgtttctccattgggtttgttttaccgccgtaaaacttcaccttgccgtttggcagcttaatggctacctggtctccgccgcgtcccagtgctaagtccaagctggattgcgccaaatcgccaagttctttcagggaagagactgaagccccgacaccgacgcttaacgtcagcgctacaccgtcaaatgaggttttttcccgcacttcatcaagaatcgaaaacttcgaattttcgagttcagttaagatgtgttcattaagtacagcgataaagcgttctgaagacgtccttttcaagaagatcccgtactcctgcgcccaagcgttcagcaaagatgtcacctggctgttcatcgtgcttctcgtctggtcatccaatccttgtgtcacatcatcatagttatcaaggaaaatatatgccaagacggttctttcgttttcatatagcttttcaatctgaatttgttctgttacatcaaagaaatataagagacgctcatcccgtttgatgacaaccctaaacttgcggtcattcaatgtaaccgtttccgattccacctcttgtttgataagcggcactaccgattcacaagtatcgtaaagtgatctccccactaaagtgctttcattaaaacaagaggaaagaaacggatttgcccattctatataatattggtcattaaaaagcatgattccaatcggcatttccatcaatgcctcttcaccgacttttttcaacctgtaggacaacgtagaaatataagcatcaatctcttgtcgaataagagaatcagcacgcttaataaaaaacaaaataactgccagcagcagcacttcgacggttcctaatatccagttaaaataaaagctgatgaggattgtaataattgacagagcaatcaatgcatagatgggataccgaaacagcggtttttcataaaagcttggcatttctatcactccccaccatgtgagtaaaactcatgttcacttcaccttattccttatatgaaagcccatatctaaaacgcctaaaatgcgaatggctgccatgaagaccggatgcacaaacccaagtatgacagcaatcacagccgcagcctttggatattgtttcttatggcaatagaaaaagataaatgataacccttggatgaaaatcagaaacccgagtataaactccccatttaaagcgatagagtacagcatttggcctttttctaaaggcaaaaatgaaagcatgacaataatcaaatacagtactacaacactttgcggaaacttcaactctctaaaaggctttagattaggaatatcggggagaatcgccttaagagcggcttagcgataaggtaactgaggaaagaaaaaataactcctaccatcacaatagctgttggaaaaagatattgaacgatacccaattgttcttccatcagttttaattgcttctcaaactgtccagcattgcccgactgcttcgctacagtttctacaatatcaagagattgccggtattgtgccatcgcctcatcaatgatattgatacccaaaaactgaatgcttatcacaaaatagaagacaatactaagcatataaataagagcgcccgaaataatggcgtgcccgggctctttccttttgaaaaaatgtcccatggcaatgccggcgcaagctgacataaaagctacaataagcccgttaaaggacccgacaataaaaacaaccggaagactgacagcgcccatccatatccctagcttcaatccatgtctgatcgtatacaagatcattggcagcggcagtgcaaataacagaattgttccaatcacaggaacataaacgaccagaagcgtgatgatcgcaaacagactgattaaaatagcaccttccattaaagctctcgtttgtttcacttagtcacctcgtatcatcctgaacatacgaatagaaaagagcagcataaacgactgctctttttcatcgctgcaacatacgttgcaccgaatgtttttatatcatctctaaattttacttttatattttaacataagtccaaatcgcaagtaaaataacgctaatgtttcatgtgaaacatgaaaaatgaaaagacattctttgaaaagaatgcccatcacaattaatgtttatcatccataaagccagaagattccttgtttttctttttcgtttttctgacatacataaaaattaagatcaccagtaaaagggttgttgcttgcagaacgccgctgctaaacaagaaaaagttctttatcatgtcccacattgtgtttcacctctttgtgcatgttctcaacccgtatcctatataaggtgaatttccctttttaaaaacttcaaaacatcatgaacaacattgagcattgggcatatgctgatatggaatctgatcgataaaggagaattttcacatggatgaacgcagaacattggcttggcatgaaacattagaaatgcacgagctggttgcttttcaatcaaacggactcattaaactgaagaaaatgataagagaagtaaaagaccctcagctcagacagctttataacgtgtctattcagggtgttgagcaaaatttgagagagcttcttccgttctttccacaggctccgcacagagaagatgaggaagaagaacgcgcagataacccattttacagcggtgacctgctcggttttgccaaaacatctgtccgcagctatgccatcgcaattacagaaacagcaacacctcaattaagaaacgtactggtcaaacagctgaatgctgccatccagctgcacgcccaagtttatcgatacatgtatcagcatggatattatccgtcttacaacctttctgaactgttgaaaaacgatgtcagaaacgccaacagagccatttcaatgaaataaaacaagcagcaaaggagttttccctttgctgctatttctgctgatccttcagtaagccgttcgaacgataagattccagcacgtctctgttggattctccccattctttcatttgcaaaacaatcggttcaagcgttcgcccgaattccgtcagagagtactcaaccttgggcggcacctgttgataaacctcccgatgcacgatgccgtccgcttccagctccctcagctgaagagtaagcattctttgagtaatactcgggcagattcgccgaaactcattaaatcgtttcttgccatctatcatgtgataaaaaagaattcctttccactttccgccaatgacatctagagtaaattcaactggacagccttctttgttcgggtatatattcttttttccactcattcttgaccctccaatagtaccttttttgatactacattacattttgcaactaagctacccagtattttacacaccttttctccttagctcaaagaaaatgcttcttattcacatcaatttttaagggtttgcatgattacacctgcagccagacgtgttaaactatataaagattacactacttaaaaaaaggataggagctatcatggaaaagatacttattttcggacaccaaaacccagacacagatacgatttgttctgcgatcgcttatgctgatttgaaaaacaaactcggctacaatgctgagcctgtccgtctcggacaagtcaacggcgaaacacaatacgcgcttgactatttcaaacaagaaagcccgcgtcttgttgaaacagctgcaaacgaagtaaacggcgttatcctggttgaccataacgaacgccagcaaagcatcaaagacattgaagaggttcaggttttagaggttatcgaccatcaccgcatcgctaactttgaaacagctgagccgctttactatcgtgctgagcctgtaggctgtacggctaccatcttaaacaaaatgtacaaagagaataacgtgaaaatcgagaaagaaattgccggccttatgctgtctgcgatcatttctgattccctgttatttaaatctccaacttgcacggaccaagacgtagcggcagcaaaagagcttgcggagatcgctggcgtagatgctgaagaatacggcttgaacatgttgaaagcaggcgctgatctaagcaaaaaaacagtggaagagctcatttctcttgatgcgaaagaatttacactcggcagcaagaaagtcgaaatcgcacaagtaaacacagtggacattgaagatgtaaaaaaacgccaagctgaattagaagctgtgatctcaaaagttgtggctgagaagaatcttgatctgttccttctcgttatcacagatatcttagaaaatgattcacttgctcttgcaatcggtaacgaagcagcgaaagtggaaaaagcgttcaacgttacattagaaaacaacacagccctcttaaaaggcgttgtttcccgtaaaaaacaagtcgttcctgtcttaacagacgcaatggctgaataagcaaaaagcatcccgcgtcgggatgctttttcttattcacccagcttctcaatttgtcccatcacatcagtaatttgctttgcgttttggaccagatctgactgctccaattctttaagcgataccttgccttcctcggcttgtttcaacacctcttcagcgcttttctgcaaggtttcgttatgctcctgaatggttcgatgaatctccgctgcggcatcaggcggcgttaattcattaaaatcagcggcatccttctgaatcgactcaagctgcgcttcaagtttttctttcgcctcggtgtcatttacagctttctcagccaattcaggcgcttcctctgcaaatgtcttcaccttctccacataccccgctgcttcactcgtatagttcaatccgtcgttcacctgatcaagcatgccgcatccgcctgcactcaaaagtcccactccggcaagtactgtcaaaatgatcttcatcttcagccccctcatcgtttctttttcattttttcttttaagatcggaatcaatttctctttcgctaacggcagccctttcctcaccaattcacgcttcagccactttttcagcttagacattctgatgctcctctccctttttgataaaaatgaaaaaactccaccaatttggtgaagttcctgaaacaaaaagaccttcaccaaatcagatttggcaaaggtctcgctaacaatgagattgccagcaaagccgaggacaccttgtcccgtaatgacgactttactgtgaaagctactcccctttggagtgttcatttttattactttcattctaaagcaccgatctgttccagtcaaattccagccgtttatataaaagcgcgctgtggtatttaaaatttgaatggtttttccatcaggagatcatgctatgacagaggaggttttcatcatgagtcaagagcgcgtgaaacggcctgggcataccagatggtacatatcttcgttacttagcggcattattattcttaattattttgaccgagtggccatctcggtagcggcccctgcgatacaagattcgtttcaccttactgcaactgaactcggcatcgtgttttccatttacacctattcctatacactgatgcagctgcctgtcggaagtttgctggaccgttttggggtcgcatgggtcacgagggttggaatgacgatatggagctttttaacgatccttcttgcttttttgcaaggaaaattgctgttgtatctgttccggtttctcattgggctgacgagcgcctctgcgttccctgctgcctctaaggcaaccgctctctggtttcctccaagtgagcggggattggcaaactcattgttcgattcggccgccaaattttcaaacgtgatcggcgcgccattggtcgcgtttcttgtcacaacatttgactggcgtgtcgcttttttgacgattggatgcatcaatgtgctgtttacgatttttttctggcagtattatgaacagcctgaacggcacaaacgcatttctaaaagtgaactaaactatattcaaaaacacaatgccattacaacagagcaaatcccttacaaaacgggcccgcttttaaaaaagcttttcaccaatcggaaagtatggggcttaatgatcggatttacagggtacgggtatacattcaacctgctgctcacctggcttccgactttctttaaacatacatacggtatggatctcatgtcgtccggtttatttacggcagtgccgtggctgatctcaaccatttccggaattgccgtcggcggctggctcgtcgattattttattaagaaaggctatcctaacaccaaggtgtaccgaaccgtaatcatagtcggaatgagctttggctttttctttttaggctccattctgacgaacaatattaccgtagccattatttgcatttccatcggactcgccggaatttcagcaaccgctccggtcggctggtccatctccgcagaactcgcgccgatcggttccgtatccatgctgagctccatggtgaatctcgcaaacaacctgttcggaggcattattgctgcgtcactgacagggtatttgtttgatgtgacaggctcctttaccctcagctttctggtagctggttttgtgctgttgctgggattggttttttatgtgtttgtactaggggatgtaaaacgaattaaactggaatgaagagtgcttgctgaaaagcactcttttctttgaatccgccaggtgttattttctttctcccacattcactagtctgtcttcggacgaaaacaccaccattttatccttgactccaaccaaaggtaaggcctcatagtgaaagaagaaaggaggagtcggatggtgaaattaacagtaaaagaactatccaatattgcgaatgtcacaatcaaaacgctctatcattaccacaaaatcggcttgctggccccaaaggaaataagcgaagccggatatcggtactatggtgctgacgaactaaaaagactgcaggaaatccttttttacaaagaattagatattcctttgtcagaaattaaaacattactaaatgaggatgctaaaagaacaagtacattagaaaaacaaaaaaagctgtttgaaaagaaaattgaaaagtatcagcatctcattcaaacagtcaacacatctttagaatacgcgagaaaaggcgaaaacatggatcataaggtaatgtttaaaggatttgaaagcgctgaagaatggaaacaatctttagcagaacaaaatgggtatttaaaagagcgttacgattttgaattggatacacatacaatcaatgtcgatgaaatgaacaaaatggcaatagaggctaaacattttcttgataggatggctgattttttaagaaatggtgtaacgtattatgacccttccgtgcaagagcatgtcatgaatcatcttaagttcctaaatcagaacgggcatccgacaagtaaagaagattacgtaaaacaaacacgtttttttatgcaagatgatttccatagaggaatgttagaagagcagcaagccggtttatcttattatttggttgtcgttgcagaacacctgtagtgttttgtcaccctttatagggtgacagccatcaggattacgagacagcaccgccaacaatcgaaacattctgccggtcaacggcaaaacgccgtccgttccatttcaatacagtttgaacatatcccaatgagtcggcgttataccttcccgctatccgctggtacgccaataattcgtatacgccgtctctgtcaaaatcaaccggatacaagcccgataaaggattcacccatccttctatcggcatttttaacacaccttggctgttataaatctcattcaaatattccctgcctttgtaagtaaggtcgaggatatacgtttcgttttgctgatgactgatgacgctcgctttatattgattttgatacctcacactgtactttaattcatcattcaatacatctgaattgaaaattcgccggaactgcctgtttagataggcaaacacatatgcataaatagcaccgccacttccccctgtatccattaccactgccacatcttcaatcttgtcgcctgtcatatccccagaaaaagtgacggattgtatcccatattgttttgaagctgaatctgctgctcctgatgggttctgccatcacggatcaccaatgtgatatctctccataacgggctgccgggcatttgatttccagttagaaagacctcgtcaataacgccgtctcccgttacatcaccgtgagtagatgcaatgattgcacgtgaggagacaggctgccgaaatacgtatggatgttgaacaagtcctctgccttcataaaaccaataaggagtataaggagccattctgatgtcatacacattcaattgtgtcaccttccctaatcagctgaatgaatcattatatgcaggaatggcacatcaaagacatatcttacacaccaattaaatccgtaccatatgaattatcaattacacaaagccactcgtcttgcgcattcttcttaaatacataggtcgcccttctttccatcgcatactcggagtcctttttatccgaatcaagcagtgtctgagaaaggacgagtaccgtgtcacctgcttccaacaggatcatttccccttgtgtcgggacaatatgatgattgaaatagttcgcaatcgtgataaatgcttttttgatttcttccttgcctcgtgcgatcatgcccggcttcacaactaaaatggcatcttccgaataataattcatcagtgtatcaaaatcttcattttggattgccaaatcacacgcagagatgatgtctttcaattgctgttccaaatgaattcccccaatcatcatgattggatatattatacatcgctagaccactgaaaccttgaaaacaaaatgaaaagtatccttttttcctatataatcaaatagatatatttaacaaagtacccaagtgaaggggtgaacattattgtctgcggaagtaacgttacatgacaatatacatcatgatttaagtgcggattgccagcactgttttggcctgtgctgtgtcgccttgccttatgcgaagtcggcagattttgcttttgataaagacgggggcacgccttgccgcaacttacaatcaaactatcaatgttctatacataaagatctcagagaaaaaggatttcgaggctgctctgcatatgaatgctttggcgccggccaaaaagtatcccaaatcacttatgagggaaaggattggcgaaacagccccgaaacggccaaccagatgtttgacgtttttcctatcatgcagcagctgcacgaaatgctctggtatttacatgaagctctttctatagatatagccaagccgattcatcctgaactgagaaccagtttcgaaaaaatagaaaggctcaccagactcagcaaagaacgcttgctgacactgcaggtggacgagcatcgagctgaggtcaatgaatggctgttaaaaacaagtgagctggtgcgtgcccaagcccgccatccaaaactcccgaaaaaggtcagccggggaagtgtcctgatcggcgcgaaactgaaagggcttgatctgcgaggagcaaatctaagaggggcgctgctcatagccgccgatctgagaaatgccgatttgagaatgacagactttatcggtgcagatatgagagacgctgatctcagcggcgccgacctgaccgggagcatctttctgacacaggcacaggtgaacgccgccaacggcgattcgaacacaaagctgccgctgtctttacgaatccctgcccattggaaataaaaaaggacccgctaacggtccttttttactgatcaattcaatcctttttcgttccttttatccggcactttcgcacttcttgccaagtatcccgacagccataacgcaaccagcagcatgaaggtgatcataccgacaacgcccagccagtgaaaaccagaccagaatagccctccgattgttccgaaaacacttgaaccggcgtaataaaagaacaaatacagcgatgaagcctgtgctttgttgtgaagggctctcctgcccacccagctgctggcaactgaatgccctccgaaaaaaccgaatgtaaagagggcaatccccagaattttcactgccagcatattgtttatcgtaaataacgcacctgcaatgacgatgaaaatattcatcaccaatattttcggatagccataccgatcaaccattcttccaatgaaagacgagctgaaaatgcctacaatcatcacaataaagatccagctggaaaatgctttattaagcgaatacggcgggcccaacagcacatacacaatgtaattaaacaaggcaacattgcttccaagcagcaaaaaaccaatgagaaacaagctgaatagtttacggtccctcaagtggccgatcagagacattcccaatttcccgagcttcaattttcttggcgtaaaatgcctggatggcggcaaatttataaaaaatataacactagcaatcaaactaatgacaccaattgatcctatcgccatatgccaattcaagtactcgctcaggagcccggaaacgatccttccgaaaacggcgccgattgcatttccgctgatatacagccccatcgccgacccaagacttccgggttcaatttcttccccgagataagccatcgcaatcgacggaaggcctgcgagcgcaacgccttgaatggttctcaatacgagcagcgtatgaaagtttggactaaaggccgatgccagacagagaaccgatgcggccagcatggaaatacccataatcggcttgcgcccccacacctcggataatgaaccaaagacaagcatgctcacagctaacagcattgtggtaacagataaagaaagactcgccgcagtaggcgttacatgaaattcccgcgtgaattcctccatgagcggctgtacgcaatatagaatcgcaaatgtattgaaacccgcagcgaagaaagcaaacgtaatttttcgaaaaaccggtgtgcctttttgaatgtatgtcatcgggactttatcggtccctcatcatgttgtggagcactgccattcataaacaatcatcctttatttcttccgaattcaaacatcctcgagtctgtttatattactatcttagcaccgttgatatatgttgtataatgcatataaaatatcattttcatgcttatatgtaataaaggagggatgataattggaatgggaacaacttgaatattttcaaacactggcccgaatgcagcacgtcacgaaagccgcaaaaagcctctccatcacacagcctgcgctttcacgctctatcgccaggctggaaaatcatttgggcgtgccgctatttgacaggcaaggacgatccattagcttaaatcaatacggacacatttttttgcggcgggttcaggcgatgatgaaggagtacaccgaaggaaaagaagaaatccaagccttattaaagccagaccaaggcgtagtctctctcggttttttacatacattaggcaccacgctcgtgcccgatctcatcggctcctttcagcaggaatactccaacatttccttccagctgaagcaaaaccactcttattggctgcttgaacgattaaaatccggggatctggacctctgtctcctcgcttcgattaagcctgaaaatccgatccaatggatcaagctgtggagtgaagaactctttgtatttgtgccaaatgatcacccattagccagtcgcgaaagcattaccctgaatgagattgccggggagcgttttattttattgaaaaagggctatgcgcttcggatgacggtcgatgagctgtttgagaaggctgatatacagccgaacattatgtttgaaggagaagaagcagctactgccgcaggttttgtggcagccggactgggcatatctattctcccagacctgaaaggcttagaccaaagcaaaatcaccaaaatccgcgtcagctggccggaatgtcagcgtgtcataggaattgcctggataaaaggcaggtttttatcaccggttgctgagacctttaaacaatatgtgatcagccatttttctgagtagggaggattcaaacatgaatgtcaaaaaaatcacgtcagaacaggatttacatacagcttttgaaatcagaaaggcagtatttgtagaggaacaaggctgtcccatttcggatgaattcgatgagttcgatacactccacggtgattgccagcacatcctggcttatcatcagaatgtacctgttggcactgcacgtgtccgtatcgttggccacacggggaaactggaacgaatctgcattctgaagtcttaccgcaaattcggtttgggaaaagtgatcgtcgatgcattagaacgtattgtgaaagaacaaggcatttctgccttcaaactgcacggccagacacaggcggcaggcttttatgaaaagctcggctatcggactgcatcagaagaatttatgctggacggcattccgcatgtgctgatgacaaaacaagacgattctgcgctatagattgttcacaattttgtcacttatgagcatgaacagttcattggtatactaatcatcgattatggagagaaggaatgattgtatgccagcaaataaaaaagaaggccttatatttggcgtgatgatgtgctttggaatggtttgcgtcatgtcgatttacaatgccatcatcaacggagccatccacgatttttcactgatgaccgtttttgaaatggtcatcggttttatggtcgccctcctgttagatttactgttagtgggccccctcgccaagaagattgcattccgcatgccgttcgacaagactaaaaaaatttatgtcatccttgccatgtcaacttgtatggtgattggcatggtactttgtatgtctgtgttcggtttagtgacagcggttctagcaaatgggctgaacggggacggcctcttcagtgcttatcttatgattgtgttgaaaaatttcatcctggcctatccattgcaattactgattatgggcccattagtcagagggattttcatgaaatttgtaaaaccaaagctcacagccgcaatttaaatagaataggagtgagcctgacactcactccttttgctcatgaatcgaatgtaaaacaagctccgcaaaagcctctgcggcaggcagctgccattttttctttttgggtgtgagtaaatcggatcgagggcttcaccatgctggagatttttcagcttatgtttttcacttccattaatccctataccttaccacatagtttttatacaattcttcgttataaaggatttcttcgccatgtgaagagcaaatgagcgttggtttgatttgatctatgattgagccgctgtcgatgttctcatttatatcaacactgaatcttcttataggtgggtgtaaatcctccttacttgtgataaaaaggtcgcccgtcaatagcgtacgatcgattttatgataatacacaacatgccccggcgaatggccaggtgttaaatagtatttcagaggcagatgagcaagcgtttgctccgtcagcggctgtacaatatgggctacccctgtgttctccacttcatttttgttcggatatggctcttccccattgatgtactttagttctttctggtgcgcaaaaatcggaatatcaaatctctctaaccattttgatgcacccccgatatgatcactgtggccatgggtaagcaaaatggcttttggattgccgatcgctaacgctgccctaatttgagcatcagcaaaacgttctattcccgtatcaacaatataaacatcatcaccatctttgataaaccaggtatgaaccggaatacgaagaggcacatcaagctcaaattcacattgaaagacatgttctgatagttgtctcaaattcacgcaaaccatctcctgtggaaattttttgatagttttaaagaaaacagaagtgaacggactattttcacccacgctcgagctgactggattcttgagaggaaacgccgattttcgccagcatcagctcaacttgttaacgttgtccattaataatcccttttgttccccttcttcacatattcccaatcacgttctatattcttcctcactctatgaaggagtgcagaaatggtttccttttcctctgaagtaaaaccggacaaggccacttccgtggaatgttctccttctcttcttaacaatggatatacctttttccctttctcagtcgggaacagtttttttatttttttattttgctcatccggcagtttttgaataaatccctgcatttccagcttcttaatggcccgcgcggccgttgtccggtccacttttatcatttccgccaatttttcttgaataattcccggattttcgtatatacgcacgagatagagatactgccctcttgttaagtctaaatctttaaattcgatgttgcttatggaatccaacgctcttgctatcatgccgatctcacgcaaaatatcattcattcctaaaacccctcacgtatttttgttgcaattacaacaaaaatgttttaaccttactattataagaccacatgcgtgctgtacagtccagactaatatcagaaaaggattgattcataatgaatataaaaagaataacaactgaagctgatttacatgaagctttgaatattagaaagacggttttcattgaggagcaacatgtatcggaatccgaagagttcgatgaatttgatacgctccaggaacaatgccagcatgtcttggtatatcatgagaatcagcctgtcggcacgggccgtgtgcgcatcgttgaccatacagcaaagctggaaagaatctgcatcctaaaaccttaccgtaagtatggattggggaaagtcatcgtaagcgggttagaagaaatcataaaagaaaaaggactgactgcatgtaagctgcatggtcaaacacaagcagcaggcttttatcaaaaactgggctaccagatttcttcacaggaatttatggaagacggcatccctcacgtcctgatgacaaaagacatatcgcggatttaacatgaaatatattttttacggattaggcatactcatattaagtttgggcatttccttaaccatacaatcaggactgggcacatcacccttcgatgcccttttggtgggtctgtcaaaagaagtcggacttaccgtaggaagctgggaggtccttatttctgtgatcctcttaatctgcaacgctatattaacgagaaaaaaacctattttgctgggcttgattacagcattcattactggaataggcattgatctttggttgtttgttgtaaaaaacaccctctatctaaacgcgttgttaagcaaactgatttgtttcggaattggtttggtgctcatcggtcttggaacagccatctatcttcagacgaaattcgcatcaacacccatcgatcatttaacacttattatccgagatctctccaaaagaacaatcttgttttcaagaacattggtatacgctcttttcttagtattagccatcatctttaaaggccctatcggcatcggaaccctattaaccgtctgtttgggaggaatgatccttcacgtttttatgcctattgtggaaaaacaattcttatcaaaaaaaagaaggggttaaaaaaacctcttctttgaaaaaacgaaacgcaaaacaagctacgtttcgttcaataattttatgataaattaaaatttatagtaccaaaaaatcgcaatttcatttgctgttggaaggttggaataaagcatcgtatcaactgcacctattataaagtgatgtttggcataaaaacgacaagctgaaacattaatatcttgtgtttcaagcataagaccacaaaagcgattctcctttgcccactcaatcgctttatgtaataatgctgttccaacgcctttttgtctatagtcttttgcaacggcaatgtcctctattagtgcatacccattccagttagaacgaatcttaatccggccgatgcagttgttttcaacataatataaaaagacaaccttcccttcatcttcaatataactaacatccatttcatcatcttcatattgtttaaaataaggtttagaaaatcgttcctcagtatatgtccaaacaccgttttcaaaagtaggtatcattctcccaaaaacaacgaaaggttcgtttggtttattgaaatctttcaaattcatttgagtcattttcttgatcatatcaatcccctcctaaacgagattatattagcatactcgtttcgatcgataacagcttccaaaagggcactctttaaaagaacagcatccattaccttttatatatagcgatttttctatttcactgtcttaatggggtatttcaacagaggcttgtggtacagtaaaaaggaatagaaacaagagaaaagaagatgaacctatgcccactaacaataaactcaatgagaaatatcatacttccttcaactgcccacaaccctgttgactagtatccgtggagagaggaagctttgacacagcttctgccattggtgacatctctattgaagtatccaaaggacaaccaaggatcgctctttgattttttcaagaagaaagtagagtgaataaaggagtgattgagtatgttaacaagagaagatatctttaaacacgtcaaagaaaaatacggtacatcgcctgattacccgtgggagaaatacccaaactatgcttctttgagacatacatcaaacaaaaaatggtacggtcttatcatgaatgttctcccagaaaaattaggcttggatggtcatggcgaaatagatattctaaatctaaaatgtccccctgacataagtgatagcttaagaaacggggaaaatatcttacccggatatcatatggataaggaacattggatttcaattgttttagaacggacagatccagaaggcgaaatctataacttaatcgagcagagctttcatttaaccaagtgaagataaagagtgttcctgctaatcgagctgcggagagtagtgggcactttcattttagatattgttcttcactttgtccataaacgcaacttagtcgatctggtgtgtgagtgggagaagaatttctaccaacttcttatggaaaaggatgaatagttatgacaaataacttaaaacagagaagaatcattttagatttagcagttactttagatggttttattgaagggaaaaatggagaagttgattggtgcattatggaccctgatatggggtttactgatttcttaaatcaaattgatactattttatatggcagaaaaagctacgatttatggggacaatatattccaaaaaatgaagaccctgatacagaaaaggaaatttggaaattggttcatagtaaaaagaaatatgttttttccagaacacaaaatgagattgataatcaagccatatttataaatgataatattcttgaagaagtaaataaattgaagaaaaagtctggcaaagacatctggctatatggtggagcgagtctcattacaacttttataaatttggggcttgttgatgaatttagattatctattcaccctgttgttttgggagaaggaaaaccgttgtttattgatgtaaaacagaggataaatttaaaaatggtgaatacaagaacattttcctctggcgttgtgcaaatcgtttatcattggaatggctaaaaaaatctttccctccaaaatatacattgtaaggtaacactcgacagttatttttcttattgaactaaagggggaatccaatggttctccttaatactattgaattatcaactttaacagagctaaaaatatccattctcttgtattaaaagaagaagactggaaaggacgcattaacataattaaacattattttatatttcattctccctcttttaagtaaatcggctaagttttgtgtttataaaaaaacgaaagaaggtgatcctatgcccactaacaataaacccaatagattattggctgagaagtctactaattttacttcaacatgctcataaccctgtggactggttcccttggggagaagaagcatatgaaaaagcgaaacgcgaaaacaagcctgttctcgtatctatggggtatagctaacgatggctaatctaaagaacatgctattgatgccatgtttattcattttacaaaaaaggatcaaccttggattactttcacaagattgatcctttcactcatttagcgatgcctccgcgaacgtttatatacattcaagattactagccaacaaataacaatgattcctgcaaaaagtatgagcatattgctatacaaataggtagagtgatcaacgtcaataggcagcagcctatgatctaggaagccgatagataataaaccgcctacaatcgcaatacccgttccctctgataaaaagctcgtgaaattaagcaaactcattccagcgcccgcttccttttctttcaaactgctagacacaactgtagatataactgtttttgtgaaagatagcccccaaaaacaaaaattactataattgtcatgatccatggtgctgcatctataaaaaaggcagcgattaaaaagccggaagaaagcaatgcacttccaatagttagtacatacaaggaacctttccgatcaacaagcaatcccccaatgtaaccaaagatgatgacactcattgttccggggaaaataatgccgcttccaattgctgcagtacttaaatggtgaacatctttcatcatgtaaggaaccatagagacaaatcctgctactgtaccaaatattagtcctccgcaaagggttccaatcacaaaaaagacgtttttccctaattcagggtcaacaaaagggtcctgagctttcctaatgtgtttcacaaatatgaagaaagcaaggatactgatgatcagaaaagaaaatctataagatgttgtaaacagcataaaaaatacgatacctgcagacatcaatataatccctgccatatcaatgtgtcctcttattctctcttcctttttcaacaattttataagaaatggaacggtgataattgttgcagttggaataagcagcaaatacgaccaatggatataatgagcaaccattcccccaatagctggtccaacaccttctcccattgctactaaggacccgatcaggccaaatgctttccccctgttctcttttggaatatagcgcgcaacgacaaccatcacaagagctgggaatgcggctgcaccaatcccttgaataaaccgggctagaatgagtatagaaaagaaagagtgtccaacaaatccaatgatcgacccaaagccatttaccataatcccaaatagaagcagatttttgatgcccatctggtctgatagctttccatatagagctgttccaatggagaaggttaacataaaggcagtattcacccagtttgcacttgctggcagtttattaaaatcgttggcgatatcaggtaatgagacgttcagaaccatttcatttaatacgctgaaaaatgatagaacacaaagccaaatcaaaacttgattgtgccgtaaagttgactgtgaataagacgtattcacaatttcccctccattaatgaaggcagacgcagtttatagggtcattgatacgcttccctcttttaattgtaccctgttcattttattgcacttcataataactccccctacatttgattgatatgatcttattatatatagactaaggtttaaacttttactttttttataaaaatttgaccagattgcgaaacaaggaaaaacgttattcacatttatctcaagtggcaaaatgaaacattagtttatattttcacatcacaattatcgataagcagtcagttattgtatttgtttaggataactgtggtaacctgaatataaccaacttaggaagaaggtgatcccatgccaaacaaaagtaaacccaatagattaattgctgaaaagtctccttatttactccaacacgcccacaaccctgtggactggtacccttggggagaagaagcatttgagaaagcgaaacgcgaaaacaagccggttctggttagcatcggtcatccgacgacttgtcattggtggcctgggataatcaaatcgtgtggaactccattaaaagataacagaagccattttaaacgataatactatttgttcaaacaatacagtctaccttttatgtcattcatttttaaaacctgcaatccgtaaccatgcggtagcagttttttttatttgcttgacttagagttaactctaaattgtaaactaactttaattaaatgagagggatgatgttgttgtattccattagtaaagctgctgagaagactagtattagttcgtatacattaagatattacgaaaagattgggttacttccaccaccaaaacgaaaaaacagtggaaggcgtttttatacggagactgatattcagttcatgttattcctgaaaagtttaaaggaaacaggtatgtctttagaggatattaatgagtttgtcaaagacggatgcattttggaaaaaatcaattcggatgttaaatcggcacaactctccccatctataaataaacgtattgagattttaatcaagcacttagagaaaatggaaattaaaaaaagggagctagaagaagtgatttctacgacaaaaggaaaactggatacatattactcaattttgaaagaggaagtggaaaacaaatgaaacatttaaatatatacctgatgttacttggcttctctatttttacaggagctacttttaatcttgcaaaatatacggttggatatttttctccatcgtcttctgcggcatggcgtttcggtttagctgctgcggtgatgctcatcattttgatttttactgaaggtataaagaagagtcaattacagaaaaacgccgtttcatacattgttcttggaattataggaatctttggatttaatgccttgtttttcgttggtttaaaatatacatctcccgttaacggagcattaataatggggctgaatcctttattaacagcaattctcgctcgaattatcttaaaggacaacatgacaaaaaaacaagtactcggcatattctttgcattcatcggtgtattgttagtcattacacaaggttctatcgaaaccattaaaaccttatcaatttcaggaggagacttaataatctttacaggtaacgtttgttgggcactttatggcgtacttggacgtcggtttgtaaaggatggtacaccgctatctacaaccacttatacgatggttatcggtgctgttagtttaatagtagtttccttatttacatccaaacctgtttctttatcgaacatcccgattggagtttggggggcaattgcttttatggctttctttacaagtgttttgggttacctatggtggaatcaggggattaaagagattggggctagtaaaacatctttatttttcaaccttgttcccgttgtaacgatgattatttcatttgccgttggaacaccaataaaggtatttcaagttattggggctgtgttagttatattaggcgttttaaccgcttcgggggtaatacgtagtcctaagtacaatactaaagaacagtcagctatataaagaaatagggattatttttgagaaaatgtgttaagttaaatatacactaattataggaagaaggtgatcccatgccaaacaaaagtaaacccaatagattaatcgctgagaagtctccttatttacttcaacacgcccacaaccctgtggactggttcccttggggagaagaagcatttgaaaaagcaaaacgcgaaaacaagccggttctggtcagcatcggttattcgacttgtcattggtgccaagttcgtatagctacactaaaataagaattcaatataactgtatcaacggtgtttccagtatctattcaccattggttttcctgctcaccagtgcagccacatctcttaaattaacttaaaataaaaatagaatagtctttcgactattctctctctactaagacaaaatattacctttcaaatcagatattaaagtttagtcttttcaaattcttcaccccaatccctcataactaaaattagtggctttaagctctctcccaattttgttaaagaatattccactttcggaggaatctgtttatagatttcacgatgtataatcccgtcaccttctaattctcttaattgaagtgttaacattcgttgtgttgcatctggaagtaattttcttaattcattaaaccttcttggaccagaaagaaggtgatataagataagcgccttccacttacctcctataacattaactgttactgcaacaggacatgctgattcatccggacagactttaccactcatctacatccctctttctttaagtataaaaattgatactataatacaaatttgtttctatactacaaaaatgtgcgttcttaccacaaaaatataattcatttatgattggagatgcaagaaataatatttataaaaaaggagtgtctattatgggttcaaagcttttctctccattctacattaaggatgtgaaacttaaaaaccgtattgttatgtctccaatgtgtatgtactcagcaaatgaagaaggtaaagtttctgattttcatagagtgcactacgctagcagggctttgggacaagtaggtttaattatgactgaatcactagctgttactgcaaatggaagaatagccatgggtgatttaggaatttgggatgactctcaaatacaaggattgaaagagttaaccagcctgcttcactctttcggtgcaaaagttggcgctcaaatttcacactcaggtcgcaattgtaacctagaaggtgtaaaacctattgctccttctgcaataccgtttgataaaaattcaaaaatccctttagaaatgagtagggatggtataaaacaagtggtccaagcctttagagacgctgcacgtcgggcacgggaggctaattttgatattcttgagattcataccgcccatggttacttattaaatgagtttctttctcctctttccaacaaacgtgaagatgaatatggaggcagtaaagaaaaacgttatcaaattttaaaggaaatcataaatgaagtgaagaaagaatggaaaggaccactttttgttcgtatttctagtactgactataaagagggaggaaatactccagacacatttatttattttggaaaacgcctgaaagaacaaggagtagatttgattgattgcagttcaggcggcattgcccctgtatcagttgattcatatccaaattatcaggttccagctgctgagaaaattaaaaatgaagttggaatagcaacaggagcagttgggcttattacaactggcacacaagcagaagaaattcttacaaataatcgcgccgatctaatatttataggaagggagttactaaagaatccattctggccaagaaaagccgcagaagaattaaatgaacaaattgaagcacccgttcaatatactcgccatggttcagtgtggatataatacttaaaaagagcaacctgattaggtttgctctttatcttttaataaaatcataattactagcattatttatcttctgttattttcaataatattacttttgtgcaataacaatttgtgggtgccaagttcgtatagctacacacctataattatgataatctagaattatattacattcaggaaatcataaagggtgatgaggtgttggagttaaaaaacaaaatcaagcgagtagccatttatctaagaaagtcacgaaataaagagggcgaagaaacggaagaaacattggcaaaacatcgaaaaagacttcttgatattgctcataaaaacaattggcagtatgaaatattccaagaagttgggagttcaatggatgaaatgcgacctgaataccaaaggatgattaacaaactcactgatggcatatttgacgctgttttgtcagttaacttagcacgggttacaagagatgatgcagagacacctaaattcatgaaccttttacgccaagatgacatactctttgtcactgatagtgaaagagtatatgatcttgaagtacaagaggactggcaagcattaaaatttactgggttcgttaacaattgggagtacgagaatataaaagcccaactaagaaaaggaaaaaaagacagtgcaaaaatgggtcgctggtcaaatggcacacccaactacggatatatttataaccgtttagaaagaaaattggaaattgatgaagagaaagcaaaagctgtaaagctcgcatttcaaatgactattgatggcataggtgctgataatatagcagtaaaactaaataaattgggatacagaacaaacaatgggaagttttttcacggtcaaagcattgtcagaatgattcgatcggagatatataaaggatggattgttgctaatcggttgaaaggaagaaataaaacaaacggaaaaataagaccacaagatcagtggattgttgttaaagatgctgttaaaccctgcattatagataaagatacgtgggacaaagcaaacaaagctttagataaacgaaagttacttaaccctagagccaaaatgagaaaacacggattatcctctttaattgtatgcggtttatgtggaagaactcactcagttactatacgtaaagatagaaataacatgagagtaattcaatcatgtagaaaaagaaacccacttggcgaaaaatgcattaatggtggaatacaatataatataatgatggaattaattataaataatataagaatgaaaaaggatcagatacagttagagcttgaaaaactaaaagacgcaaacgaagccattgatacaactgaaattgagatacaaagcattaaacaacaaattaaaaaagtcgaaaaagcattacaaatgctccaacttcaattagaagaagacttaataagtctcagtgactttaaagagagaaaaactatccgatcaattgaattggataatcttcaaaaagaattaaccaaattaaaggaaacatcaaaagaagataagataaaatacaaagaatcattcatcgaatacttagatcactttctcaataattggtcagaattagatgagtcgcagcttaataatgaattgatgtcttttatcaaaaagataatatggtaccaccctataggaaataataaagaacatcgtgaaatcaaaattgattgggctgaataagtcaagcccttaattaagggcttgctgatttactattcattttctactttttcttgctgatttacacagtgataacattgtccttcccataatgcaatactcatatcgccccatgctattttttcaccacaccactcattaggacactcttccatatatagattattttctaacatatcaagtgctaatgcttttaactgagcatcgcttaatgaattaagacctttatccactgcttgtttcgctgaaccgattgcagcaggatgaattaaaacatcatcctctaatatttgttctaagtaatcataaagaccccaactatgtgcatcttcacctttatgatctgaagcatcgctttttaaacgctcaactaaagaatcaatctctaatttactaaccacttgattacctcctcatttatttggaatacctctattgtactaaactatggaaaaaaggataatcatttacttatccgtactcgttataacggttaaggaacagcagtgactgaaataatgttatagtcatctgacatctatgcaaatgcgaaaataaaaaaggtattgcgtgcgggctttctgatgcaaagtgttaatcaaactaaaaaaagaggagtaaacacacggtttactcctctaactttgtctcttcaccttttgcttcttcataatctggtgttttccttgataagccaagtcgatcattttctccattccccggcatatcagtcatcttttcatatttatctcctattttttcataatacttaaatgttgttaattcacgtgaagagttatccggcatataaaatgcaaactgaatatatttgcccccttcatagactctaacaatcgcattctctcttttaatatttatctctgtgtcatttcctttatgctctttatattggctaattacatcatcaatcgcatcatcatacttgcttccaccacatgcagttaaaacaaacaccatcatcaaactaaggaaaataaaaaggtttttcaaaataaacattacctcctttttcaatatttagtataaacaaacaaattgatcttttccaccttttatccatttcccttaacctgcacattatcgactaaccaaccatccttttctttcttcatagtcgtttgtacaattaacacttgattcgtagtgactgaatttgcagttgtggcgacttcaacaatgtttaaaaacaattcatgagactcatctaacggctttgaataactctctagtgatagtaattcactttgcacgctgactgtgtgcttttgatcagagcgagaagggaatgcataatcaaacccttttccagttgtgtgcttcttaactgtttcatatcgtttatctatgtcggaataattaaaaaacgcttcaaaaaatgccttattttccgaagcgctacttgttgattctatatggttcaattccttaattttatcgctcaaaacttcatttttatcttttaacttttcaatcttatatgtttgctgtccattcgtaaaaaatccagtcagcaatatcaataataaacaagctgaagcccatgcaatatgtgttttcatgttttcactcctagttatttaatgcgtccaaaagatacaaggtgatctctccagtaacctgatttcagatcagaatattcgattccactgtcatttgaattaaacattctgccattgcctacatagatgccgacgtgagtaatggcttttccttcgtatgtgccgccaaagaacactaagtcacccgcagtcgcttctttttcacttattttctttgttgccccatgttgttcttgtgctgttctaggaagagtgattccagctttcgcaaaagaccactgaacaaggcctgaacaatcaaatccagttttcgggtttgaacctccccaggcatacggttgcccttcatatttcaaagcttctttcatgaccgtttcatagaaatccatagagccattcacaggcttcacatttttatcagagcctttcacatacctcatgacatggtcaacataacttgggtcaccgtagcttttccagcccattttaaaagcttgcaatcggctgaaatcaagtgctaatttctttgtgtatttcccgccattctttttgacatagtctataaatccagaaccaaagttgtatgcctgtaaggttaaacgaacatcaccaccagcctgtttaaaaaccttcttaaaatgtttaatgccgacttcaatcgaacgttctgggtcagttatggagttgggaggtaagccgatactttcggaactttgcatgatatctaaagaacgcccaccactttcttgcatggtgagcgccataataatattcacttggtcaaaaacgccttcttgacgggcatatttctcaaatactgctctaaatcgttccacttccggcgcaattccaactgtttcatattcgccatccccgccgcctataaaatcgtccccgacttgattttctcttgaaatcgtcataaccactacgatacataaaacaaaaaagaagataaaaggagccgagaataccaaaggaagaactacctttttacttatcatcttgttctttcatcccttctcagtcgatcttctacttttgatgaagagcgtcttgcaatttcattcaaagacacttggtcaaatgaattaacgctttgttcagtccgtttaattgtttgtgatgaaggctgtttttctcttgatacagtcttattttcagcaggagcaacagcctgtttttcatcaacacgaataccatctgaatgactttttgcgggttcagatggtctgatttcacgttcgttattggcaataggctgattttctacttttgtagattgaggactttcaaaaccgaactgcggttcaggttgattcatcatgactttttgatctgaacgtttgatttctgctgttttctcttgtgctacaggctcactattggaaacagaatcatctttctggacttcaaaattttgttgctgatctgtttcaagattctgattttgttcgtcataaacatacgctttctgatcagtacgttctgtatctttttcattctcttgtaagacaggcgcacgattagaagtagattcttcttcatgttgtaatgatgcatcgtcagtttgttgctggatattggtctgtttatgaagctgttccaaatattctttttgatctgttcgtgctgattcatcttttttatcctgcaagataggtgctcgtttggataaatcctcatttccttcattcaaagcatctttcagcataggagagtttatcccgtcttttctcaatctgtctaaatgggattgctgtttattttcttttgcatttgcaaaggcttctttttgtttttgcttttcttgttctttcgatagagtttgaggatttcgttttaagcttcgactgttatgattagctattccgttagctgtttctttttgcggggttcttgaaatagcatgagtattatcatatcccatagcagccccactcggtgaattaccgccaccacttggagcaccagttacgccatcagcattcgaaccgtcttttcttccccaaaatgttttgtaaagtcagtaaatacaccgcctccgttaccccatactccacctattttcttcgcttgttcccaagcaggctgaacaatgttttgtctcatgttttccatcatattattatcaactgaaacaacttttccagcagtcacaaacttgataatggcatccctcttgtgaaaaccaatccacaagattgaagcaaggacagcaacatttaaaagatacattccaaaaccatttggcggtattaacttgtcaacgataaaacaagtcacgtacacaaacagaacgataatccctaacattgctttcagtaggtaaacactccccaagcgaccaagcgtaacaaatcccgaataagctaattgaggaacatacgctaggatgaaagcaaatggcacaaagaaaactatcactaaagcgacaacttgaagcaagaaattaaagaacgctaatgctaaaaatggtatcccaatgacaatagaagcgaccacagcgataaaagactctcccagctgattaaacacatttccagaagtcatagattcatttttataatcatcaatttcagtctcttttatataatcttttttatctttttctccatcctctgaaagcttataagaaagcagtttatctatacgattaagtccgcctttatctgtatctttctcattgattttcttttcgcttgtttcatcaaaattcacaattaaaaaaggcttcattaaagcaatgtcaaagtaaagattacgcataaccgcaaccgtgccttccatttcttttcctttttcaatcgctgaactgtctgcaaaattgccttcatcttgaacaatgccaaccaatccatttcccgcagttaaaagctttccttgcgcttctacagacaaggcattcaacgctttcatgtaataaccagcgttcgacatccaaagcccaccgatcaccataacacaaataaatagaatactccgccgcattgcttcttttacgctacctctcacacagaataggtagacaacataggcgcacgtgaaaataaataaagcttcaccgaaattctttttcagtgttttataaactgttttagagacgtttgtaatagaatttgcgaattcgtcaatcggttgcaagttatacaaaatatccatccccgcatcaaccacacggacaatgtttcccgcaaaagaaaaagtgacgtttgtcagcccaacaaacgcccccttgattaaatcgtcagatgcttcattattcgcttgatagcgtgagataggaaaccttttcaccttcaattccacaccgccagctttttcgacttttggttgcgtcgttgtatctccatcagccgaaaataccgttacagctgaagcaacagttaaaaacagcaacacgatagcagacacaatcagtatccttttctttttcattacagccacctcctaatctaatcgagttaataaataaaattggtaccttgctttctctaagtctctttgcgttaacagcacattttcgggatatcgttcatacagagagaaacagattgctttttgatatttcatatgtctgaaagtctttcggttttgttcaatcttgatacccaataatttttgcaggaactgcgctgttgatttatgcccgatgaagcttttgtatcgaccgtcataatgatttagccatcgttttacttcgtccagtgtaattttttcagctttataaaatcctggactcgtgaccacaagcgagtttaagaaagctatttccatgtacaattcaaccccttttacaaatatttttcttccgcatatgcgacagcttttttctcaactgttttcagagcaccttgccattcttcgaataggcattcaattgaaattttggaggtacgaccatagtaatctttaaataagcattgaccttggaacatggattccatcatttttttgttttcttttgtgacctccatattcatccacttcaacacttcttcacgttcatttggttcgtcaaaggcgaaggcaacaccaaagtttccggaatcttcttctttcaaagcgtcttttgtggattgggaaatgaagtattccgcattgttgtatgaacgaccaatccggcgcatttgtctttctactttttttccttgttgtgacgtggtaaatatccacgcttcgtctataaattcaactgtctgttcgtctggattcatgccgaatagttcgcagaacttaccgagtgcaaacatgacagcactagactttaattgtgatatggtgtagttttcaagtcgctcagcatgatctggcaaatccatattttcaacttctaaaatggtgattcgtttttcaagtgacaatgcaggattggagccatcatgaatacaaagtttcaaaatggaatcttgcacaacctcatttaaatagtcaccagctttttgtacagcttcttccggatggttctgcatcttccgaataatatcaagcgaaccgacctgttcgcctttttgttttgcatcaattacttctgacgtagcacgaaggaaagctgtgtttatgtcgtccttccctttaaagtcatatacttgttcaaaaatgacttgaactagctcttttgctttcataggagggaggaaggagatagggtcaagtgctccccagttgtgcgtgttttcatgatctagcgtgatatagttgtatttctctaaatgtgcaatatataagggaaagttctctctaatgtactcatcattcaagactctttgaatccactttctcatttcctttttagggtctatatacaaagatttgatgtttaacatgctgatatagttaaagatcaattttgctagatatgacttgccgtttcctgtgtctcctgtgattaagcagtgaggagaacgtgtctttgaaccttttaactgctgattcgctaagaaagggtggaataagacaaaatcacggctggacataatggcactttctaagtcggtgtgctcttggaaacgatcaacccaaccgagaaagaacccgattttcgaaccaatatcagagttaacagcaaacagactttctgccacaccgtcttgcgttgttttttgaatccagttcttatcggttatgtctaacttttcaccaggaagcattttataaaaaaggttcagttgatcagccaccggaagccgacaagtaatgccagcgccttttaaatgccttttgacaatcgttgcttttcccacacattctttttttgtctttccatgaacgactatcactgacagccagttcatcacatgcacatcttctttctttatttcatcttgtaaatgccttatcattgtggcacttgtgacagtggaaacatcacttcgatcgcctgtgctttgttgttctttttgttcttctttcaattgttgtcttttgaggttgagggcaggcttggtaatggactttgattccgtttgaattttcatctgaacttcaacagggaagggaagagactgtgcttcataaaacaaatcactttccgacatattgtgaagaaattcgtcaatcacgacaaaagctgaatagccttcatcttgatcactatgcaaatgcaatactgatgggtcagtggggtctatgatcgtgtttgtaatagagcgaacatcctttatctcactttcttcattcgtttggtgctttaacccacgtacaaagtgataacggttaatgtatgtcatttctgtttctgaaagccgttctccgcgaacagaagccatgatattcgctagtgtttcttcgacttcctcatatttttcaaaaaaagaggtggaaacattttgttcccacccgagcattttcacgactgtatcagtcgctgtattgaaaaaagataatatattgtctttaagttcgacactaatatttacaagactgcttttcagttttacacctaaaatgaagtcatactttgtcagccttcctaatcgctgttctaacagccttaccgtttcttcattgtagtaacgtgtcacatctattgcatctgcggcaatatctgtttctaaatccttaaatcgtttttctaattcatactcacttggatacatcatcaagtgaaaatcctcataagatgtaatttcttcaaaaagatgctgccacttcttcttatacgattcaactttttctctattttgcataggaatcgaattgctttttattcggtagtacgcccacacgtcgcccgttcttgttaacagtaaattcttgtgtattgccttcataggcgtttttagtctcatttgaataatccaccaccttcacaagtttttgaaactcaatttgtttttcgttacttaaatcaacctttcggtcattgcaatacttcttttgtggaagcttgatgaagaagtaatattttgcgaaatcaaagaaatataaatagatgtttttgccttccggctttattttcgtcacaagcatcgttaaaaaaaatggtattccaaaaatcacgatgacgtaactattatcaaaagcgtgaggaaaaatcatcctcacgccgtaccagaacccaaagcataggccaacaaaaatgaaatagttaatagccggtattaactcaactgcaaagggtaacgaataattttcggttaattgctgaatttttttcggctctctcattgctttccggtagttgaacaccagacgccccattcagatgcccccttacaatttttccattagcgcattgatccagccggagaaatctgaccagtgtttaataacccacgtcaccgcactgccaatacagcaaacaaagataatgccgcccatttttaatttcatcagattctttgcggctatgaacatgaccacaatcgtaatgaattggataacaacatctgaagcccatccttttacccctccaagtgttggaaggtctgcgccaagaataaagaaattcatgaaatccatatttaaacctcctattgatgtttgagtttatttacataaaactgaccgctgttttccgtaatctctaaactaaatttttcatttacgggaatatcattttctttttccttaaatcgaacagcacaaaaaacctcgaaaccttttttcgtctcgaagattttcattgactgcacttccccaaataacaagtttccttccaacgcttccggctttttcatcatataaaccatttcttctttcttttcagaagcgtatttctcgaagaaagtatgaaggaatgattcgatagattcttttttctcgcctgcatattcgtctctagtctcttctttactctcagaagcaatattgcctttcagatcataaatctgtgtaaagtaagggacagcagacaccgcaaaggaatcacctttatttgtgactggaatattcagcaacatttgtttttcagatttctcgtttgttttaaccttttctttcaccttcttttttttctttccgtctttaacttctttttcaacttccttctctacagggtagagattttcatatgtgaccttatattgaaaaaggctgtttttatcaccttctttcacgttatataagctgtaaccctttaactctcgatcaccttttaagccattcacattaaaacgatcttcatcctcaaaatggttatcttcctgtttcaccatgtagctttcaaggctctgcatgcgtttttcaatagattcttgatcgttcttcacattcacatattcattgatgaaccctgacagaaagttttcagcagcagtcaccgaaattttttgtttatcgtcatttgttggcttattggcttcttcttttatgtcattaagttgggatcttgtgttaattgatagaagcacagcgagcaagcagataaacagtaaacccccaacacaaaaccacaatgtaactgcgatcagcttcgacctgtcacgagggactttttgtttgtctttttccggtctttcaattcgtttcaatttttgaaaggcagaccgaaaaaacgactcttcttttttatccaagtcaatttctttttggagcaattcgattcactctcctttcatagatttctaagcactttcctcctggttaactttcatgtttcttgtcattttcaaaatggctctcgccattttttcatagttcggttcatttaattccgtcacgataacttccactggcttacctttaatttcaacgacctcaacactctgtttcatgaaagacctcgctttcttcaaacctgttttgttttttcaaggaataataaaaaggatgctacacgatgtaacaccctttttatgctttgattctccatataaacttttaaactagtcattcgaccgtccggcaaatatcttgtcttgtaaaatgtgtaacgatattcagcaaatccttttactctttctccttctacaactaacatacaatctctgcttaaacttcttacaaaaactaaagagggaataccaacattaaagcccagtcttttgaagtgattatcaaccgcagacacttgatcacctcgttatattcgtcctccgtttttaagatgattttcttcgtaatcttttcttataacatgaggatcatacattacaaattcgacaagaactactccgtcatctgattccgtttcattttcttcaaggactctaaagtgaaaatacaagttcgcaaccatgtccccgccgttatcctttctaacatgaataatgatcatttgatcatatcccgatgaaatttcatcccttaatctttcgagtacgtcatccaacaagtgcatattaagatgcctttctaatgtgtttataagggaggactcatttataatcctgtaatccatgttttcacccctcagtgatagtaggttattccttcaaattcgacgctccgttcatctgtctcaaaatcttcatcctccagtatgttgaatgtggcttgaagtttagcattcacgttatctataaccgcaagagtttggactatgactctttgagcaacatcactgtaaaagacatcttccatcattttttcaattaattcctcagcaatatccaaacagccaagagactccaaatcactctctagtcgggcctgattcaacagattaatgttaaacatcttatccctccgatttaagttcttgggtttcacccaaacccaccaacggaagcccgttggattgctgttaatctatccccctattccccgaatcatcggggactccctcgccggtaggcaggaacaaacggttgtttgttcaatgccaagagggttttggtggcgctgaatatgtcaactccttatcctcacttcgttccggtaccgttgacacatacgtttaatcgcatcacctgtgtttataaagatttatcagcttgttttttaaacgaccatatcagtaacatcagcaagaaacacatctaacatttttttgtgtttgtctgccagttcagcttctgcaatcatatctgatagatcggttttccctaaatgttcatcagcttcaagcaccattttcatagtgggggcacaagagttgcgaagccagtttcttgatttctgatagaagtctttttgtggtttgacatacaaaggaagtttcccgatatcacctataaattcagaccaaaaaaggctcgttttccaatgctctctagtgatgttttcatcagcatcaacgaaccttacatagttattaatgatctgcatagcgattaaggttaaatcctttgttttcaataaagcatctatagccacttgtgcacgttcatttttaagccgcaattcataacgattccaatcgcctagttcttctaacggaatgttatacttttctgcttgttcatagtttttctcataaaagcaaaggtacgcttctgactttttagaaccgaaatatattgtcgttccgcctgtaatgccatcagatagatcaaaggagccattgaaatcggattttctaaagcgtgaaatacattcgcccttttgggctttctttaacaattccggtatagaaaagtacgtctttttatcatcaatagccaaatcaaagcgagtaaatgaaccgcctcgtgccatgcaatcttgaaagaagtcataccatgttttcttccggcattccaagaaagattcaaattgacggcaaccttgaccggacatttctatcaaaacacctctgttatcatctggcgcagaataaaagactttgatatagtccagttcgtacgtaccaacgtagccatagaaaccagattgtttctccgtcataaagtctttgctaaggtgaagaacctcttcaataattcggtcaacatcatgagttttaaaagagactcgaatatagtcaaccattgataccaaaggactttcaatggtttcatttttttcttttacgattactacccccctgttagcgtggggggttgttttagctcatccattcgcttcgctcactccttcgccgctggccgtctggtcgcttacgctgccgctggcgactgccgtcgcctgcgctccctcgactccaaccagcgcatttttaatagatgacataaaatcatatccttttggcacgatagggctgtaaaactccaacactgaacctgtgcccacattggcatatcctcgccctgtctcctttttattcacatatgctttttcaacatcgccaaacatcatcccgtagcccgtatctgacattaaacctagcgacacacggaagctaaactgatcacgaataccatcagctaaatattttgcatctggacgttgtgcgcctaaaacgagaaagtaacccgcctgtctccccaacatgactaactgtttcatgtaagaaagagcttcatttctttctttcatatccaacaaatccataaatgccacatattcatcaaagaagataaaaacaggttttaaacctaaataggcataattttcacctgtcttatagttaggcatctgtttcatttcatccattcgttccatcatgccatctacagactttctcaggcacataagaatgccgttcttttgggaatatacctttttcggaaggacttcttccaagtctgctaaatctgcatttttagggtccaatattcttacatctgcccccagtccaacacatgctttaataatcgttagcatgaagtatgtttttcctccacctgtaccacctgcaataagcatgtgcggcaacttatcaaattgccatgaaatatgcttcattaacggaaggactccattctcagctactgcatcatcaatggaaatacgattcttcttcacatcgtaaagaagcttaaagcatacaaaaccttcttccatttgcttatccaccaggtcacaaaataagccgttttccaaatcctttcctaagtctaggaagcgattctgaaaacggctcatgtccatagcaatacgaatataaatgtggttgtttttaacctgataatacattctaggaaagtatgtgatcttttcctttgtgtcagtttcatttgaaaagagttttcttactttcacattttctctttcgtaaaacttattggagaaaatcatttttgcaatcttttgcctgtgaagaattttcttatagctgtcaaagaaaagaaagtaagatgcaactatgcttccaacagcaattaacacagagaataaaacgcttttaataattaaaggcacattccactcaaagtgttttattacttgagatagatcaaaattaatcagttgttctctccaaaagatgaacatagacaataaaaaaacaggcacaaagataattgcgcctgctaattttacgttgtttctcatgtacgggcggattcgtctccccctatacttccaaagcatcgtcttaatcccagaaatggataacacactcctaacgtttatttttatctttctttttctcacgccacaatttcattatgtccatgattaaaaaatgaccaccaaacatgacaaatatacaaattgaaagaaaaacagtcatgaaaatatcaaacggtaaccatcccactggcttacgataccaagcatagaacacaaaaaatactagccacaaaacaacacgaacaattatagatagagttatttttgttctaaatatttttacaggtttttttataatttttaaagacccctttcaatgtttagtggtctttacactacgtttaccaattatccaaaaaatgatagaatatacacatttagtactaagtttttttttgaaagggaaataatatgtttgataaactcatcggactttactttaaattttcaatatacttaacccatcttcttatatttagtattatcttagcttcatttcatccccaagtttttacgcattttttcagtgcaattgtaaaattaattccagtatcaattattaactattttatagaaaagaatataaaccagactgatgtattttacatatttacaattgtttcagctatttcagggataggattgatttggattcagtttttccctagaagttatattaaaaagatgagaaaagtcggcttagacataacagagtatccatcatttcatatggcttcaatttataataaaagttctgagttaactactctttttctactcagtattattttgtttatagaaacaaatgttacaccactttcaccacttaaaagcttagtattaaatttactgcagaatgctccttttgtttttcttttttgttgcattggtacagtaggggctatacttaattgcgtatcgttaattatgtctggttttgcaactattatagagaagaaagatacaccttagaaatagcgtgcccattactacgagcacgctattctttttatttatttcttatcattcccaccagttgccgccgcaggtttcacagaagaaccaccttttaaaacaatatcatcagcttcaagtttccacattacattggcaaaagttgaatccctttgactagttgccatagcgctaatttttgggtttttcaactcaatgtcagcaaaaggaggaatttcttttgccccagcatactcaggaatagttacctcaatttgaccaccttgcacagcactagcaatgttataaaccctagattccagtacgtcagtacgcttattgttttcccgatcataaacatatctttctttgttaagtcccatgaatttcatgtctccaaaagtcatattgatatccggtacaataaagtttaagttcatttttcatatccccatttcattttttattatttattttcaaaagatcgtttaatttcgattttatattggattcgctccggttctgtatccatcttggcgcttatcagttgctaacggctttttcgccctcatggcaacctagtaggctaattatagccatcaagctgactacagctattccgcacgcttattctagcctgctacagcatttatagtgattgccgttcatcactcaaatactcacgcatgacatttcaacaagaataccgtataataaaagtgtctagtttttattttccggcgttcttgatgatccttcgtcaaggcgctttttttgtctatatgtagttttcaaggaacaaacactcctagcgacataagttatacagatcatcgttatacaaagtaaacacttgattttccttcttactcaatggacggatagaccagatacaccaccaatcccagccttttaacagatcagatatttcttcattagccttcatataattatcagcatcaacaacgaatgtttcacaagtgacataatctttaaaatggtttaaatccttatcagcctttaaagcttcgacatctgtgattattgttgcattcacccttattttcatcgcatccccctttcaaaggattcttaacggctccctatagtggtatataacgtcacactatggatgattgccgcagcttttcaatgtcttttcttccgattccgtaatgtttacatatccttcgatacgaaacgccttttcgcagtaattcattaacattttcaattgttaagggcaggtttaaataatgatttattatgacggaattcagagcaattttcattcttgctatccaatcaccttccatttgtcttgccaacggaacagcttctttcataaataaatgagtttggtttaaaccgatgacactcacaccgttgttttatagatatatttctcttcaaatctggcacggctgacttttcctttaacaactttgtatccctcttgtttgagttcctcatttagctccctaatgatttcatatgcttttgcctgccctacccccaaaatgttttggatgttttcagcagttaaaaattctttcaaacaactccctccttttctgactttttttcgtcttttcgtttataagttaattataattaaactatacgtttaagtcaatataaaattaaactttttgcataaaatcaactggttttttgatttcagtgcaaaaactaactttacatataatgaatgtaaaaccattttatttatgcaattagtttaagtcaacaggtaaattaaacttttagaaaagataatcgataagtcctagcttggttacaattgatggtgataatataaaaataaactttctgtagattggacgaatttatatgagtttaggaaaacgattaaaagaagcgagaaaaaaacgtggactttcccaaattgaagttgctcaaaaacttaacatttctaaccaagtcatttctaattatgaaagagattttcgtgatccagacacaaaaacattaaagcaattaagcgacttgtataatgtttcaactgattatttagtaggtaaagcccccattgaaagcaacaataaggcttcaaaattgacccaaacatttaatgaagtaattgaggaactaaaggatgaggatacactactctttaaaaatgacggtgagtttgacgaagaaacagctctcctaattaagaaggcattaaaaaatggaataaagcttgtagatgaattaaagaggaaagagtgataccaatttatacgagcaaaaacataaaacacaaagtacagttaatcttgttgagttacggaactaatgatgtttatgaaatttgcgaacaactaaatataatcataaccgagaataacttagggcaagccgaaggtttacttcaacatcttaaagaagaaaatcgttatattattcatacaaatgaaaaactaacgcaccaaacaatccaaaaattcattgttgcccacgaactaggacattatttcctccacaaaaatttaaatgcttttaaagttgctaattgctccgctgtcttaaaagataagttagaacaccaagcaaacatattcgcttctgaattgttacttccggacaaattattaaaagaacatttattcgaaatacaaaacttaacaatccatcaactagcatctttcttcaatctacctacacatgtcatacagcacaaacactcacaattaaaacttctgtcaagaaaccgaatggaaacaggaattaatcatgtatgcgaaatctctatataaagaaaaaagcccactcacgaaaaacgagtgggttcactttagcttccaagccgatctgatgcaatactgattacgttttcagatttagcttgatgaccaaaagtatctgaattaaaggataagcccagtattgtcgtccccactaaaatcgtcatcgataaggcaatcatttttttcttcatgaataatctccccttttcgaatttcatttctggctgctattaccttacgataatattcgttagagagcgaagaatttcctttttcataataaaactctgcaacctcatgggcatattcttcaatatcagcaaataatttctttgattgaaagtaatctaaggcctcattaattaaagaaacatcttcatcagaaaaatataatccctttaacaatttgaatttggcttggtattcataatcattgttacgcatagcaatggcacttccttgttcaaaataaagaagcgctttactcatttcccctttttgggctaatacatgagacaaattaaataaagttttagacataaaaatatgcttttcctcttgaaaaacttgtaatgccttcatgagattttgaatcgacaaatcatattgaccaacactcctataaacaatacctaaattcatatgaaatgttgcaatgagatatttttttccgattttaaaagcatcctgtaatccttttttcaattccttaattgcactattgtaatttaaagtatcaattaaattaccagctacaataaacctgcaatgaagtattctttcatcatgaatgtcgaatttctggtatatctttatagctctctttgcataacttagtgaaaaataagtttgtttcatatagtaatatacttctgatactttaaaataaaattctccacgttcaatctcatcttcaatctctgataatttggtttcagctaaactataggcgtttattgcagaaacaagttcttttcttctgaattcgtacattcccatgaaaaagaagaaataatactcaagcatttttgacaaactgccttctttttctttcaaaatttcgtaagtattcctaacttcttcaacatcttttgatctcaaataaattagcattagttcatgtctaaaatctaacagttgataatatagaagtatatcttgcttcatctcgacttcttctaaaagagattcaatttcagacttcttcttttgggcttcttcaatcatatttttctttatggtggtataccatgaattcaatttagatattaaaatttcatacggaatcctttctttttttatagatgtatgatccaagaaaatctcaccccgcagatttacaaaattattcgaatatttacattaattgtattatgtcagatcaaaaagccatttacaattcttaatgtaaaagggtacattttggctacacgcaagcaatatgattgcgttttttttgcggcaatagcaatactttcgtttcttgacatgatattatggctttacattacaaaattatattggagaggtaagaaatggacttaaggaagtataaatttaatagtaaggatgacttcatcttctatctaagagagatattggttactgcatctaaaaacatatcttatctagaaaataaacttcaactactcaaaaactacattgatgaaagaaacctgatagagagaccgaaacgagtaatttctgctgaaatgtatgatgactataagtcaactatttcaaacacgacaaattatttgtctaatttattcggtgatgcttctgatcttggtatctcctatcgaaattacagaacatttgtaaaaaagaaagctgatgaatttaatttgaaatatttggacttcacgcaagagcaagaagaacttatgaataagataaccactgctagaaactggagcagtcatataccagcatccttaattaattctatggaagaaagagttcttaataaaaaagttgatattaatattccaatatttgtacctaaattcgaaagatattctggtatatggttagtggatctatataataattcatttgaaatttttcataactataaaacaatcttcgaaattgcatttaaagactatgaacaactgatcgaaaaacgaactgtaatttttgaaaaaagcgttcccttaagggatataagcgatttaatcatccctaaggtatccagtgaaattcaacatcgaaatattaaaagcacatcagagatacagcaaaaatatatagaagccaaaaaagatgtaagcaacattatcaacttaaataataaataagaaaagagtgtaagaattgcaaattgattggtctactgtaatctcggtatcaatacctctgttagctgctacatctggacaaataatcgcccaccaacttacacgaaaaagagagaaacaaaaacataataaagaatgctttcaaaatctttattctccaattatgtttcttataaatgattacattagtgcagaggcattaaaagtaatctttatgagggaggagaattatagcgaagaagagttcgaaaaagaggctaaggatacctattttaatcccaataggatttttggtgaaattttaaatttatttagtcttaacttaaagtatgcaagccatggccttatttcagaattttatgatgtaaaggtattatttcagatggaaaaactcaatgaaatagataatcatgggatcgaacaccgaattgaatttatttatagatttctacaagactatctaaaagctgctaaaaagttgggtatagtgctgcccagaaagtttaatagtgatatattttatatttctttatataaagtattagataattgcatttgtactaacttgtcaagaaatcttattaatgaccacattctcatagatcaccttagtcaaaatgaaatactcattaaaaaatcagttaaaattttaaagcatattgaactcaataacagtaaaagatataacagaaagaaagtatacctaaaaacatttgcatttcttgacgagctctgtaacgatattgatatgttcgtacccgatattgcaaaagtttggagaactgaaatcgaaactgcaaagagacacaaattaaattcgttttatatggaaagaaggtgatccaatgcccactaacaataagcccaatagattaatcgctgagaagtctccttatttacttcaacatgctcataaccctgtgaattggtttccttggggagaagaagcattcgaaaaagcgaaacgcgaaaacaagcctgttctcgtatctattgggtatagctagctcgggtagctacacgcacatgtcattggtgccacgttatggctcacgaaagctttgaagacgaagaaatcgcgcgtcttctcaatgaacggtttgtggcgattaaagtcgaccgggaagagcggccggatgtggattctgtttatatgagaatctgccagctgatgaccgggcagggcggctggccgctgaatgtgtttatcacgcctgatcagaagccgttttacgcgggtacatattttccaaagacgagcaaattcaatcgtcccggttttgttgatgtgcttgagcatctgtctgagacgtttgcgaacgaccgtgagcatgtcgaggatattgcggagaacgccgctaaacatttgcagaccaaaacagccgccaaatcaggcgaaggccttagcgagtcagcgatttcccggacattccagcagcttgccagcgggtttgatacgatctacggcggtttcgggcaggcaccgaaatttccgatgccccatatgctgatgtatttgcttcgttatcatcacaatacggggcaggataacgctttatacaacgtgacgaaaacgctggacagcatggcgaatggcggcatttacgatcatatcggctatgggttcgcccgctattcgactgatgacgagtggctcgttccccactttgaaaaaatgctgtacgacaatgcgctgctgctgaccgcttataccgaagcctaccaggtcacgcaaaacagccgctataaagagatttgtgagcagatcattacgttcattcagcgggaaatgactcatgaagacggaagctttttctctgctttagacgcggatacagaaggagaagaaggaaagtactacgtgtggtcaaaggaagagattctaaaaacgctcggggacgatctcggaacgctgtattgccaagtgtatgacatcactgaagaaggaaactttgaaggcaaaaatattcctaacctcattcacacaaagcgagaacaaatcaaagaggatgccgggttaaccgaaaaagagctcagtctcaaactcgaagacgcaagacagcagctcttgaagacacgcgaggaaagaacctatccgcatgtcgatgataaagtgctcacctcatggaacgcgctgatgatcgcgggtcttgcgaaagcggcaaaggtataccaggagccgaaatatctcagcctagcgaaagacgccatcacatttattgaaaacaaattaatcatcgacggccgtgtgatggtccgatatcgtgatggcgaagtgaaaaacaaaggctttatcgacgattacgcttttctcctatgggcctatctcgatctctatgaagcttcgtttgatctatcttttttacaaaaagcgaagaaactaacagacgatatgatcagcttattttgggatgaggagcatggcggattctacttcaccggacacgatgcagaagccttaatcgtacgggaaaaagaagtgtacgacggcgccgtgccttccggaaacagtgtggcagctgttcagctgctgcgtctcgggcaagtcacaggcgacttatcactgatcgaaaaagcggaaacaatgttttccgtgttcaagccagacatagacgcgtatccaagcggccatgctttctttatgcaaagtgtgttaagacatctgatgcctaaaaaagaaatcgttatttttggcagcgcagacgatccagccagaaaacaaatcataacagagctccaaaaagcctttaagcctaacgactccattctggtagcagagcatcctgatcaatgcaaagacattgcaccatttgcagcagactaccgcatcatagacggcaaaacaaccgtgtatatttgtgaaaacttcgcctgccagcagccgacaacaaatattgaagaagcgatccacacgttaataagcagcagggattaagacccttgctgcttactttttgatttcttatggtaccataaagcgatccccgcaaacacaaggttgaccgctatcgtaaagaaagcctcccacatcgggtttccccgcgtaaccgtaaagagagaaggaattcctccatacacactgtttttttctgtaataaacatacacaaaaacatattattcgcggcatgggcgccaagtgatatttcgatgcttccagttttaatcgtgtaataggtccacacaaaaccaaatgttaaatactcaattcctgcccagacagcaccgttgttcatttctggattcgcaaaatgcaatacgccaaacaatcctccgacaatcagtgtcaaaaatagaggatttttcgtcaatctcccgaaagcttgaagcaaaaatcccctgaaaaacagttcctcagctgatgtctgaatcggaaccaaaatgagggcagccgctagcagccagataaatcgtgatgtatcaaaggcttgcattgaataattatctggatgaatcacaaaatcaatcaattgtacggcgatcatcagcaagaaataagcaataaagccaaaggaaattctccgccaattcatctttgaatttggtgttatcaccgttcggaaaggccgcttcaaaataaagcgtacagccagccaaactcccggaatggcgaataaataaatcacatgggacaaataaagatctacgaggggatcactcagcacagcttcatccaaatcaaacgtgatattgggattcacaataaccgtgaacagtatagcgaagaggtaagctatattcccgaatacatataaccctaccatcaccaaaaaagcgaaaaaatatctccacaacgtattgtttccttctataggacgaataaatgaattcattccttctatgtctcttcctttcaatgagaatattactatatatttgcataaattggtctatgaatctactgttttggaaatcttttaagcaaaattaaaatataaagtgtgaatttagttcttacatctagtgatttgaactctgttgccaatgaaccaagatacttataatagtcccaagaggggaattttcagtcttttcttactactcaaaagggggtttttatgaatacgatcttcaaacaaaagaatacacatcctttctcaaacgcagcgaatcgtttagaccgccttccgatttcacgcgttcatttccaagtgttaaccgctctcggcattgtttatttctttgatctcgcagatttatttaccctcagcaatgtagcgccggcactgattgaacattggggcatcccgctttcaactattgctaacgtaacggctgcttcgtttttaggcatgtttttaggcgcttcactgggcggacggctgtccgatcgaatcggccgcaaaaaagccttaaatctatttgtctttgttttctcaatcgcatcgctatgcaatgctgcggcatgggacattccatctttaatgacattccgttttctcaccggatttggcgttgcagccgccatggtcattacgaatagctatttggcggaatttttcccttcaagtgtacgtggaaaatatatttctttttgtgccatgattggattgatcggggttccgatcaccaacattgtgtctgcctttgtcattcctcttggttcatggggatggaggctagtatttgtatggggtgccgtcggccttatttattttttctttattcgacggctggaagagtcgcctcgctggcacgaaaatcgcggggaatatgcgaaagccgatgcgatcctcaatcgaattgaggcacaggttgaaaaggagaaaggcccgcttccggcagcatcccagcctaaagtaagcgaaactgttaagcagcatgcaggttacgcaggcttattgaaaggcagaaacctcaaaatcaccatcgtattatctgctgtatggatttttgaaacgtttgggttttacggatttgcctcatgggttccaagcctgctaaaaagcaatggcgtcaccatggaaaatacattgtggtataacgtattgcattccgtcggcgctccgcttggcgcactgctcggctccatgatttccgaaagatttcaaagaaaatggattttagctgcgagtgcgtttctgacggccatcgccgggctcttatatggtatgacttttattcccatcatgatcattgtatttggttttatcgtgaatatcacagaacgggtctttacctcgaacttatacgcctatacatctgaaccttatccgactgaataccgctcatctggcagcggtttagcctatggtcttggccgtttttcaaacatttttggctcattgcttgtcggatttattgccgttcagctcggctatatcagcgtcttcttatttattgggggctgctggctcgcgtgctccttgctgttaatcttcttcggtcctaatacgaatgcgaaacagatttaaaaaagtcagtgcggatctgccgcactgatctcattacaattgcttcaaaatcctcgcggggtttccgcctacaacagtattagctggtacatccttagtgacaacagatccagacgcaatcactgcgttatcaccgattgtcactcccgggttaatcaccgcccggcctccaatccaaacttgatctccaattgtcacaggcttaccgaactccttcccggatttcctttcgatcggatcaagaggatgaccggccgtgtagatatgtacacctggcgcaatcaaacaatgacggccgatacgcacctcacacacatctaaaatgacacagtcaaaattaacaaatgtatgatctccgatatgaatgtgatagccataatcacagcggaatgtcggcaaaatcgtgacttgatccccaaccgaaccgagaagctccttcaaaagctccgtccgcactgcatcatcttccggtgtttcgttatattgtctaatcagctgtctcgcatgcttgcgttctagtaatagttgttgatcttccgaattgtataattctccggctgccattttttctttttctgtcctcagcatttaagtcactccatgtcagattgtaatctcgatcaaatttccttcatcatcctcaatcacactttcatagtagccgtctcctgttgtcctcgggccgtttactactgcgaaaccatccgccttcaatcggtcagtcagttcgtcaactttctcccggctcccaacggaaaaggcaatatgtgcccagcctgtcattgtttgtgagggcggatcggtcacattcccttttttcataatttccagccttgctccagaatcaaacgtaataaaataagacttaaaatcttttttctcattatgatacaaatcattcgcttcgccattaaaatacgtttcataaaaagatttcattcgctctaaatcattgacccagaccgctgtatgttcaatctgcatttcttcctcctccttcgccttcaatgaagttataaggtatgaaatgcatttcagttcaagcttttttcttaaatttatgctgaattttgatatcagcgggttcatcctgcaaaaatagagaaaatgctgcgatgccgagctgctcaaggttcaaatcaagcgacggaaaaccaagaacacggctgatagaggaattcccctcgcctatgatttcaacatcccaattattctttttggcaaatagatgaattccagctgccacttcatcactatttgcataaatagcggtcggaacccgcccgctcatataaaaatgttcagctgccagctcaccatcattcatatcgttgcacccggacagcatatggcggtcttccaaccttccgcagacagctttataggccgcagctttatcagccgtgctcgggctcctatcagcttctctgacacacgtaaaagcaatattctcatgtccgcggctctttaaatagcgaaaactctctgcataagcagcttttctgtcattaaaagcacaagggacatcgatgtctccggtattctcacaagcgatgatcggcccatattcctgataagctaaaatgctgtcccaatgattggcgcgggaagtaatgatgagaccgtctattttcttcgttcttaacagctctaaatatttgatttcaatagcggggttataattggtggggagaagggtcgttgcatactcatgctgaaaagccgccttggtgattccgttaacgattttatcaaagcagggatgatcgctataaggcagaatcacaccgaccgtatgggttttcccgcgaatgagatcgattgcggttcgatttggtgtataatccaattccttcatgacttgttgaacaagctttctcttttcttcagatacatacggatgatgattcaatacacgcgagacagtcgaaacagatacatttgccagtcttgcgatctcttttatatttgccatctctttctcctttttcatataaaaaaaacagtaagtgtaaaatccttactgctatctcatcatatattgatgataagttcaacaggacaatggtcggaacccatgacatccgctgatatgctggcatcttcaatctgttccttaagtctttcagaaacaacaaaataatcaatccgccatccaatatttctgtcccgggcgccggcacgatacgaccaccaggaataagcgccttctagatcaggataaacatgacggaaagaatcaacaaagccagcttctaagaaacgagtgaatgcccctctttcttgatctgaaaatccagcgttattccggttcgcctttggatttttcaaatcaatctcctgatgggctacattcaaatcaccgcataaaatcactggttttttctgatccaattcaagaatataagacaataaagcctcttcccattgcatgcggtaatcaatccgctctaatccccttctggaattgggcgtgtaaacagtcatcacaaacacgttttcaaattccagtgtaatcactctgccttcttggtcatgctcttctactccgataccgtagatgaactgcagcggttcttgcttagaaaaaacagctgtgccggaatatccttttttcactgcataattccagtacacatgatagccttcaggctggagatcaacctggccgtcctgtatcttcgtttcctgaagacatataatatctgcatcctcttctttcaaataagagaggaaatccatttttctcatcacagcccgcaggccgtttacattccatgaaatcaacttcatgtttcatcctccccctataaaaaagagcaagaacccgaaggtccttgctctttacgtatcagcttactcaccgcttacgtatggaagtaaagccatttgacgtgcgcgtttgatcgctgcagtcaatttacgttggtatttagcgtttgttccagttacacgacgtggtaaaattttaccgcgctcagaaacaaactttttaagaagatctacatctttgtagtcgatgtgcgtgataccgttagaagtgaaataacacactttacggcgtttcgcacgaccgcctctgcgtcctcctgccattgtcatttccctcctttctttttcattttaggcgataatcacattagaatggaagatcatcatccgagatgtcaatcggtttgccgtcgttggcaaatgggtcatcattaaagctgttcccctgattgcgtctctggttgttttgatttcccccaaatggattatcattttggcctccgccaaagtactggcctccgccgctgtttccttcgttgtatccacctgaaccagaaccgccgccgtttttcggctcaagaaattgaacactttcagcttggacctctgtcacgaagacacgctgtccttgctggttttcatagtttcttgtttgtaaacggccatctacgcctgcaaggcttccttttttcaagaagtttgcaacgttttcggcttgtcttctccaagtgacacaattaatgaaatcggcctcacgttctccggactggttcgtaaatgtacgattcacagcaagagtaaacgtagcaacagccgcaccgtttggcgtataacgaagctctgggtcttttgtcagtcttccgactaatacaactcggttaagcataagaaagaccaccttttaccattatatatttcaaaattgcttattcttcttctttaacaacaatgtggcgaatgatatcgtcactgatcttagctagacggtcaaattcttgaactgccgcagcgtcagcttgaacgtttaagatttggtagaaaccgtcgcggaaatcattgatttcgtaagcaagacgacgtttaccccaatcctttgttccagtgatctccgcaccgttagaagtcagaacgttgttgaaacgctcgataactgcttttttagactcttcgtcaatgtttgggcggataatgtacataacttcgtactttctcatctgtttgcacctccttttggactaagcggcccataatgggcaaggagcaataattctattactcacaattttatattataccaaagctcttgtccctttacaactgcatcctatacattaaatcggaaatgaataacatctccgtcttggaccacatattctttcccttcaaggcggacttttcctgcctctttagctcctgccataccgccgcccgcaagaagatcctcataagcaactgtctcagcacgaatgaagccccgctcaaagtcactatgaataattcctgcacactcaggggctttcatgccttttttgaatgtccaagctctgacttcctgttctccggctgtgaaatatgttgcgagaccgagaagagagtaagacgctttgatcagctgatcaagacctgattcttgaatgcccagctcttccaagaacatttgcttttcttcgccttcaagctcagcgatttcagattcgatttttgcacacacaacgataacttctgcgttttcgccggcagcgtactcgcgaatcttcgctacattttcattgccagatggatcagcaacttcatcttcacttacgttggccacgtacaaaataggcttcgaagtcagtaaatggagctgcttcacaagcttttgctgctcttcagtgaattctacagatcgagcaggcttttcactctcaaacgcttctttcagtttagataaaatctcaaactcaaatacagcgtctttatctttttgcttcgcaagcttgctgacgcgtgtaatccgcttttcaaccgtttccatatcagcgaggatcagctcaaggttgatcgtttcaatgtcatcaatcggatcaacctttccggaaacgtgtgtaatgttgtcatcggaaaaagcacggacaacgtggcaaatcgcgtcaacttggcgaatatgagataggaacttgttgccgagtccttctcctttagatgcgccctttacaatccctgcaatatcagtgaattcaaaagcagtcggcacagtcttcttcgggttgaccagctcagtcagcttttgcagacgatcatccggcacctctacaattcccacgttcggatcaattgtacagaacgggtagttggctgattcggcaccggcctgtgtaattgcgttaaatagtgttgattttccgacgttcggcaaaccaacaattccagctgttaaagccattctttcatctcctctatataaaaccgtcattgtatgagcgtattttgaacctagagcaattataaggaggttcactggaaaagacaagctgacaaaaaagcattttcagcctgccaatccctttgattatgcttttttcaagcctactaaacagtcaaaaagcgtacttcccattccattatcagaatttgtatcatttgtcagtgcattgactgaccctccaaaagccgcccacatgccttcatctatattaatcgtcttcgcatgagcctgtttcatcaatttcaccttgcccttcaagcgtccgcggtcattaaagatgacaacctcgtctccatcctgaagattctgctcagccgctatatctggagaaatatcgacctgaacgtgctgaagcttttcaataaacggcacatgctgtgaatggttggaacgctgcggatgaatggataacagcgtataagggtacttttcagctaactcctcattatggaaaacagattcttcgggcacatttaattgaagcgagccgctaaatcccttttgctcagctagcgacgaagtaaattcaaattttccactcggcgtcaaaaactgataatcatcccacggcacctgttttactggaagagggaggtggcctttttcttttaaacgctcaagtgtcacatcctctgcttccaatgaggaaagccccatctctaaaaattcttgagtgctgtattcaaacagctcgccaaacccaagacgttttgcaagctctgaccagatccagctgtccgacttcgcttcaccctgcggctccacaagcttcttcccgtactgaacataatgatgatacatactggaatagtagatatcttcttcttcaaaaacagtggcagtcggcaaaacataatcacacagctttgcggtatccgtcataatgaaatcaatcgcgaccgtcattgaaaccttttcaaaagcttgtctcactttatttgtattcggcacctgagtcagcggatttccgcaagtcacaataatcatctcaatcgcaggatcagcagcggtcaacacttcttcagcctgcgtcatcattgaaaaagaacgtgatgttgtttttaattccggcagcgtcagctttgtttttgcaaagctctcgccaatctggacatttccgaaattcgcgccgccgcccttaattccgacatttccgcttgccgcaacgagtgcatcaatccaacgaatcgttccgccgccgtttttatatcgctgcatgccaagccccataaaagtagacaccggaccatcagcatacaaaccggccagatactccagctcctccatagaagtttctgttttcacaataaactcttccagagaaacagttttcaaaagctctttcacatcatcaaaaccgacagaatgctcagaaataaacgtttcatccgttcttcccgtctcaatcagaaccttcaaaacggctgccgcaagccagccgtccattccaggctttacagagatatagcggtcagcaagctttgcagtcgggttgaagatcggatcaatcaccgtaatcgtggcgcccttctttttcacctgctgcaagtgatggtataagtgcatatttgttctggatacatttcttccccacacaacaacatgcttgctgttgtaaatatcaagcgggccgtgaccgtacgaacggccaaaatcccagctttgcgcctcgatgccggagccccagcatatgcttccgacgatttcagtcacgcctccatatccattaaaaaaacgctgatcaagcgcttttaacagaccgttattcgcataatcatggctgtgcaaaacagcagtcgtctccgacgtttccttgatttcccgaagtttatcggcaatttcatcaagtgcctgctcccaagaaatccgcacaaactcgccattttgttttttcattggatagcgaagccgatcaggagaatttgtttttgtctcaagcattctgccgcggccgcagattttaccttccgtaatcggatggtttggatctccgtccacttttgttacctttccatcatcaacagtcaccaaaaagccgcagctgtcccaacaattcagcggacatgccgactgatgcactttgctcatcgccgtcttctccttaccttctatatgaaaaagcatgagtgtcggcctatttatgaagtaggctcctcatgcttgactagtactttttttagttttctttcaaattctcttctcggaatcataacactgtgagagcatccctcacacttaattcgaatatccattcccatgcgtataattttccagctgttcgctccgcatggatgcggttttttcatttctacgatatcattcaggccaaagtctttatccgccaagacccttcacctcttttcctaaactgctgtatctattgtacaaaaaaactgatcataagagcaatcaagatacccgaaaagaaatacatcctcttatttccatttactcaaaataggatataggagcagacaaactaacaaatacaaattgagcatcccatatatcggatacaagaacgcgatcaaatcagaaaatccgaaagaagtaaaaggtaccattaacactaacaaaatcaacacaatcatccatctcggcatatgaataaacgccatcagccggctggacagccccagcaaaccagctaccgtcgtcgtgtaaatcgccaggcacagcaccgccgtcatacataaaaaaaggaaataaggcgcaccctccagaacggcaaacagcggtatttcaaactgagaaagggagcccgccagctccaccaacgtttcattataaacaaatgagatcacgccaaaaataagaccgcttgccacacttgcgatttttgcttctccgagccctttcatctctttcccaacagaggataaaatcgcaacaactgaaaggatgtttaaagaggtaaacgtaatgctcgcaggccagttatactgctgggacaaatcaatcgtccacgtatggtgatgtgtgctctgaaaggagaccagcgcatataaaagccccgctactaacacaggaatcaaaatactatttatagataatattcctttcacatcccacaaaaacaaacacactgtcacgatgcaaatcagcgcgattccccaccagaaaggaagtttgtacatttgcagggtcacaccgcctccggcaatcatcaccatagtcgtcgaaaacaaataaaaaatgatgaggacatcataaattttcgccagccatggcccattaaatgttccagaaccggcagaaaatgagtggattgaaccttaaaactgattttcatcacaatataagacgagaaaatgaacataattgtaaacagcacaatagcaagtccactttccgccccgaaaaactgccatatctcctgaccgctcgcatatccggccccgatcaggctccctaatatgagcagcatccacttcattccggctctccacaacactatcacctcatagacaaagttcagcttgttcccgttattgttactatataaataaaggaaagcaaaaatgccatattttcatagacatttgaacacaagttgaaattatcatactaaatactcataaaaaaagactgctaatacagcagtctaaaaagagatatttatttgtttgtccgcggaatgaagaagtgaacttcactcttcacttttttctaaccattcctatctattcaagtgtttcataagcagaccattgcttgatcatgaccgaggcaatgggggacaatacttgtaatcgcccactaaccattcatatcataacctctacttttttaaaatctccggtgccatacacaaagcataaaaaatcatactgctggatatactgtaaacaaccttacataactacacacacaccatagcaattctgttacctactataacaaggaagtgaaacccatgaatcgaaaaggcgggcttttttcctctcaggaacgagtaaagcaatatgtttcacatacagatgctgcagcggcaaaacaaatccaaaccatcctttcttcatccttacgtaaagctgccggcaaaccaattgtcgtggtttgtatcggaacagaccgttcaaccggtgactcattaggcccgcttgtaggaatgaaactcaaacagatgcagctcaccagattccatgtctacggaaccttatctgaccccgtccatgctgtgaacatgaaggataaaatcaatgacattcataaattacataaaaacccatttgttatagcagtcgatgcatgcttaggccgcgttaagagtgtgggttcatttcaaatcggggacgggccattaaagcccggagccggtgtacaaaaagaccttcctgaagtgggagatcttcatattaacggaatcgtgaatgtgagcggtttcatggaatattttgtattgcaaaatacaagactcaacttggtcatgaatatggccaatgttctcgcggaaggattgagtttaacagatcggacagagtggaggcaagaacgccttaacccgttgcaaaggctcactgggcgcatataaaacaaaaaccatcttcgcttgaaagatggtttcttcatttacgattctcgttcagacaaaagctctaaaatccggtcaaggtcttcattagagaaaaattcaatttcgattttgccttttttcttctgtcttttaatattaactgttgttccaaaataattttggagataggattcccgttcttttagaaccgcatctttcacaggttcttttttctttgtttcacgtggaacattctgattcaactgctgaatcagctgctcaagctggcgaacattgagctgctccgcaatcactttttgtaccagcggttcaagcttatttttgttttttaagccaagaagcgtgcgtccatgtcccatagaaagcgtaccttcggcaataagctgctgaatattttctggcagtgtcagcagtcttaaatgattcgcaatatgcggtctgcttttcccaagacgtttggcaagctgctcttgcgtgaggtctaagtgtttcaacaaggagtcatatgcctgagcctcttcaagcggagataaatcttcacgctgaaggttttctaataaagcaatttccctcattaacgcctctgataattcacggacaatggccggaactgtatctaaacctgccagctttgccgctcgaaaacgccgttcacccgcaacaatatcatagccttttaaagattttctgacgataagcggctgaagaatgccatgctgcagcacagattcttttagttcagctaatgcctcgtcatcaaagtgttttcttggctgataaggattagggcgtaaatcggcaattttaatttcttcaactgtctcttcagacaaatctacctgattaaataacgcattaatcccttttccaaggcctttagccattcgcagccacttcctttgctaaatctaaatatacttccgcacctcttgaccgcggatcgtataaaatgatgggttttccgtgactcggtgcctcactcagacggacattacgcggaataactgtcttatatactttatccctaaaatactttttaacctcttcaatcacttgaatgccaaggtttgtccgggcatcaagcattgtcagcaatacaccttcaatcattaaatcagtattcaaatgcttttgcacaagacgtactgtatttaataactggctgagcccctccaaggcataatattcgcactgtacaggaatcacaacggaatccgaggcagtaagggcgttaatcgtcagcaagcccaatgacggcggacaatcaatgataatataatcataattttgctttactgcttcaagcgctctcttcaatctcacttctcttgatattgtaggaaccagctcgatctcagcccctgcaagctgaatcgtcgcaggaatcacatccaagttctctactgtcgttgctttaataatatctattacatctgcatcatctactaaaatatcgtacacacactgctctacatcggctttttcaatccctaatccgcttgtcgcatttccctgcggatcaatatctaccagcagaacccttttccctatgtaagccaaacatgccccaaggttgacagacgtcgttgttttgccgaccccgcctttttggttcgtaattgctatgatttttcccacgatgtcacctactttcacatgaacatgtactatcttgcttctattctatcaaaaaaagattaaagcgtttcatttttttcatcattttgttccgaatcagaagggaaataattgaaaattcaagcacgctttatgctttctcttataaattctgcaatttctatgtttttttgacttaaaaaaggaatttcttaaagaaaaaaagaagaagtcacagtacagaacgtggaaacaggatggtgagaaaatggtttatcaaacgaagagagatgtacccgttacgctgatgattgtgtttctcatattactgatacaagcagatgccattgttccttttgtgctgggaaatatgagagtttccggctggatcatttttattctgctgactcttttaaatggactcatcatttggagctttattgacctaaaatatgtattgaaggaacaccatctgatcattaaagccggattgatcaaacatcaaattccttatgaaaaaatcgataaagtcgttccaaaaaagaaactatggtccggttttcgtctgatcggctctcgccatgccatcacaatatattatcaggggggatggggacatgcagtaatttcaccgcaaaaatctgaagagtttatccacaaactcaaagaaaagaattctaatataataattttcactaaaagtaagtgattaccttttattaaaaatataaaaagctctcctgcttttcaggagagcttctattttggtatgcgaatcgttaattgaatatattcttcaaattcttcttcttccgtattcaattttacaccgctgtcttccaccattgatagtgactggcgaatcgtgttcatcgcaattcttgtatctctgctgaatgctttgcgtctcggctttggctttctctggccttgctccagcattttcaccacgcggtcttccgtctgctttacatttaaacttttctcaataatctctgtgagcagtgtgacttggagctcaggctgtttcagcggaatcagcgctctggcgtggcgctcggtgattttcttctccataatcgcctcttggaccggctgaggcagctttaataaccgaagcttattcgcgattgtagactgcccttttcctaagcgctgtgcgagtgcctcctgtgttaaatcatgcagctcaagcagcctagcataagcatgcgcttcctcaatagaagacagttcttcccgctgcaagttttcgattaacgccacagaagcggtttccgtgtcggaaaaatccttaataattgccggaatcttttcccactcaagcgattgcaccgctctccagcgtctttcacccgcaatgagttcgtattggccttcttcttctgtatgcctaacaacaatcggctgaataatgccgtgtgtatgaatggtcattgctaactctttgattttttcatctgagaaaatggtgcgtggctgaaaacggttgggaacgatagcatttaccggtatttccagaatctcttctttgtttgtatcatgttcagcaatctccggctcctgttccttctcaccaagcccgaagaaacgagagaatgaatgcttcatgtacctacaccacctttaaaaactgccatttttataattctattttctcatggtttttcctgctgtacatccatcaattttgatgaaaatatgatggtattgtcatatcaggctgtctaaattacccttcaattggcgatttattaggagttcccggttttcttggatacttcttaggcgtattttttattttgcgtatcaccataatattacggtcgctttcttcaataggcagcttaaaagaatggatattctcaagttctcctccaagcgtcgtgattgcttttttgcctgcattcagttcttcttcagctgatgcggcttttaaagcaacaaataaaccgtttttcttcaccagaggcaagcaaagctcactcaaaacagataatctcgcaactgctcgtgccgtcacaatatcatagctttcacgcacgtctttccgttgcccgaacgtttcagctctgtcatggcagaatgttgtattctccaattgcaaagcctcagataacttttctaaaaacgtgatccgtttattcagtgaatctacgattgtgacattgaggtgcggaaagcatatttttatcggcagacttggaaaacccgctcccgctccgacatcacaaatcgtgttcacctgattgaagtcgacataaaaagcagctgtaatggaatcataaaaatgctttaaatacacttcttttttctctgttattgaagtcagattgattttttcgttccattcaaccagcatgtcgtaatacagctcaaattgctccagctgacggggagaaagggagatccctttttccgccaaaccagaagtgaattcttcaatattcatgccgtcatcctttctattcggctatcttcgcaatgcgtccctgctctaaatacaccaatagaattgaaatgtccgccgggtttacaccggaaatgcgggaagcttgggcaacagacaaaggccgtacatttttcagtttttgacgcgcctcggtcgcaatccccttaattgcgtcataatcaattcgatctggaatttttttattttccatcttcttcagtttttccacttgctgaagagatttttcaatatatccttcatatttcacttggatttctacttgttctgccacgtcttgaggaaccggcacttctggcggcgccagttttgtgactgtttcatagttcatttcaggacgcttcatcaagtctgtgccgcgaactccatctttcaattcgcttccgccaagagaacggatatattcttgattttccggagacggcttgataattacagaatgaagacgttttttctccgcctcgatcgccgcttttttcttctcaaaagccgcatagcgctcatcagaaatcaatccaatgcggtgtccgatttctgtcagacgcaaatcagcattgtcatgtcgaagcagcaatctgtattcagcacgtgatgtcaaaagacgatatggctcattggtaccttttgtcacaaggtcatcaatcagaacaccaatataggcgtcagaacggcttagaattacttcttcttttccaagcgcttttcgtcctgcattgattcccgccataatcccttgtcccgcagcttcttcataaccggatgttccgttaatttggcctgcagtgtaaaggtttgtgattttttttgtttcaagtgtcggccagagctgtgtcggtacgattgcatcatactcgatcgcatagccggctctcatcatttgcacgttttcaagtccaggaatcgttgcaagcattctttgctgtacgtcttctggaagacttgtagataaaccttggacatagacttcctgtgtatttctgccttccggctcaaggaagatttggtgacgcggtttatcattaaaacggacaactttatcttcaatggatgggcagtatcttgggcccgtacctttgatcataccggaatacatcggtgaacggtgcaggttgctgtcaataatctcatgtgtctcagggcttgtatatgtcaaccagcaagggagctgatctgtgatatattccactgtttcatatgagaaagcgcgaggcacatcgtcaccaggctgaatttccgttttgctgtaatcaatcgtgtcgcttttaacgcgaggcggcgtacctgttttaaaacgaacaaggtcaaaaccaagttcctccaaatgctcagaaagcttaatagaaggctgctggttatttgggccgcttgagtaagacagatcgccaagaataatacgtcctcttaaatatgtccctgtcgtcatgacaactgctttcgcacgataatgtgcaccggtttgtgtaataacgcctcggcattcgccgtcttcaacgatcagccgctccacaattccttgcagcaatgttaagtttggttctttttcaagcgtatttttcatttcgtgctgatattggaatttgtctgcttgcgcacgcaatgcacgaaccgctggaccttttcctgtattcagcattctcatttgaatatgcgttttatcgatgtttcttcccatttctccgccgagcgcgtcaatttcgcggacgacaatcccttttgcggggccgccgacagacggattacatggcataaatgcaaccatatctaggttgatggtcaagacaagcgttttggcgccttggcgtgcagatgcgagggcagcctcaacaccggcatgcccggcgccaatcacaatcacatcgtattggcctgcttcataccccatgattctagttcctccttttattattttcctaaacagaattgtgaaaagagctgatcaattaagctttcgtggacagaatctccaatgatttcccctaaaagctcccagcatcttgtaaggtcaatttgcaccatgtcgatcgggacatcctgttcgatgccgctaagcgcatcttcaatggcgcgttttgcttgctgtaaaatagagatgtgacgtgtgttgctgacataagtcagatcaccgctttcaatggcacccgtgtagaacagcgattgaatcgcttcttccagatcattgatgccttcctcttttaaaagagatgtcgtaacaactggacgtccattggcaagctcacggacacgttcagtgtcaatcttcgcctcaaggtcagtcttattcaaaatcacgataacatccatatcctcaacggcttcaaaaagcttcacgtcttcttcagaaagctcttcactataattaagcacaagtaaaatcaggtccgcttcctttagaacctggcgagaacgttcaacaccgattcgctcaacaatatcctctgtttcacgaatacctgctgtatcaaccagacgaagcgggacgccccttacattcacgtattcctcaatcacatcccgtgtcgttccgggaatatcggttacaatggcttttgcctcatgaacgaggctgttcagaagagatgattttcctacgtttggccggccgataatgacggtagaaagaccttcacgtaagatttttccttgctcagaagtcctcagcagcgcctcaatttcctttttcacggcggttgccttttcgactaaaatctgatgcgtcatttcctctacatcatcatactccggataatcgatattcacctcaacatgggccagtgtttctaaaatctcactacgcaaacggcgcaccaaagcagaaagacgcccttccatttgattcatagcaacgttcattgcccggtccgttttcgctctgattaagtccataaccgcttccgcctgtgaaagatcgattcggccgtttaaaaacgcacgtttcgtaaattcaccaggctctgccagtctcgctccctctctcaatgcaagctgaagcacttggttcacagtcacaattccccgtgacagttaatctcgatgacatcttctcgtgtaaaagttctcggcgcttttaacactgataccattacttcctcaacgacacgatccgaaggtctgtctacgatatgaccataatgaatcgtatgtgattcgaccgagctgagtgttttccccttcggtcccttataaattttatctgcgatttgaatggcttctggtccgctcaaccgtacaatcgcaatcgcgccttctcccatcggtgtggaaattgccgcaattgtatccatgttgttcacctctctttacttatacttcatctatataaaaaaatttttattatgccaaaactaaaagataacatagtttggttcgaagtggaagatttgttatccacagaaatagaaattcgtcccttattactttaacttatccacatgtgaataacaattaattttatttcctgaacttcctttttatcaacaggatacacctaaaaagaaaaaacttaaacggcaaaaccttgatattactaggaaaagtagatttttcggatacaaaaaaaccgaaatccaatttttatcggacttcggttttatgctatcttttatgggaaataacgagatgacgattttcgccttcacccattgaatatgttttgatctggtggtttgcatatccagaaagagtatcgtgaataatttttctttcgctggacggcataggctcaagctggatggattttttcgttttcaaaacttggtcagcaagcttgatggccagctggctcagtgtttcttttcttttcaaacgatagttttctgcatccaccgtcacatttttgtattggcctggataacggttaagggcaagctgtgtcaaagtttcaagggcgtttaaggtttgtcctcttttcccaatcaacaatgctgccttttcacctgttatatgatatctcactgtctttttgctttcttgaacagtcacatcagacttcccggcaatggcttcggcgatcgtttgaagatataacttcgcttgctgaatcggatcaatcttttcaaccagctttacgatcgcaggctttttgccgaaaatgccgagaaaccctttgtttccctcttcaataacagtaatttctaccttatccttcgttaatcccagctcttgcaatccggactgtactgcttcatcgacatttcgccctgcagcagtcacattcctcactttttctttcctccggctttttgcggctcaggattttttttaatatcaggtcctttaatgaggaaagtttgcgcaatcataaacaagttaccgactacccaataaagagaaagagccgccgggaagttgatcgcaaatacgataatcataattggcataatccaaagcatcatcgccatttgcggattttgctgcgcattgcccgccatcatcagtttttgctgaacaaatgtagcgacaccggcaacgataggaaggatatagtaaggatctttttctcctaagtcaaaccataagaagctgtgctctgaaatcgcctgggttctcatgatcgcatgatagaatccaattaaaatcggcatctggatcaaaatcgggaaacatcccgccaatggattgacaccatgcttttggaataaagccattgtttcctgctgaagcttttgctgcgttttttgatcctttgagctgtatttttctttaagcttttgcatttccggctgtaaagcctgcatcgctttcgaacttctcagctgcttaatcatcagcggtaaaattaataaacgaattaaaatggtaactagaataattgaaagcccgtagttatctcccgtcaatttcgctacatacgtaatgagctcagacaatggatatactacgtacttgtcccagaaatgcggactatctgcagtgatcggctctttcacactcgagcatccagccaaaagcatgaatacgccaaccatacttaatagcaaccctattctccttttcaacaacatttcctcctataattaatctttacactcttttattgcaaagcatacttgtatgtattttagcatctttcagttttaaatggtgtctttttctgatcaaccagaaaggaagcgcttttaaaagttgtaagaaagcagtggtgatgcctactttgacgaagatttcttatataatgaagactttctgaatagatgctgcagactttttttcgtttcctcatatgtcagctggctcgccggttttctggcaataatgatgtaatccttttccttcagtctctctttctcttcaagaaaggcctgccgaatcaaacgtttgatccgatttcgcatcacagcattgccaatttttttgctgacggaaagcccgacacgcagttcatcattttcaggctgatcaagcgtatataagacaaactggcggtttgcaactgatgtcccatgtttaaacactttttgaaaatcttcatttttctttaaacgatttcgcttcttcaaatgactcactccgatactggctggcagaaacttttaaaatttattatgaacatgagatgcatctgaaccaggaagcatgccccggttcattacgcatcacatctatcttttcccataacgtgaaaaaagaccactgacattattcagtggcctaagctgataatacttttctgcctttgcggcgacggcgtgctaaaactagacgaccgttttttgaactcatacggcttctgaagccatgaactttgctgcgtttacggttattcggttggaatgttcttttcatttatgacacctccctcgaggaatagctgttaaagacagtcttacttattatatttgcgttacctattcattgtcaacttcactagtgcttttatttcttgcaaccataataggataccataccttttcaactttcgaaaccttattttttagattccttaattttacggaaaaaagacaaatccaaataatttacccctaaaatcacgcatgtggatatctttttcgactttttttagtatccacagtggttatcgacaacattttcacattaccaacccctgtggacaaggttttttcaacaggttgtccgctttgtggataagattgtgacaaccattgcaagctctcgtttattttggtattatatttgtgttttaactcttgattactaatactacctttcctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacaacattttctatgaaaaggagggacgtgccggaagatggaaaatatattagacctgtggaaccaagcccttgctcaaatcgaaaaaaagttgagcaaaccgagttttgagacttggatgaagtcaaccaaagcccactcactgcaaggcgatacattaacgatcacggctcccaatgaatttgccagagactggctggagtccagatacttgcatctgattgcagatactatatatgaattaaccggggaagaattgagcattaagtttgtcattcctcaaaatcaagatgttgaggactttatgccgaaaccgcaagtcaaaaaagcggtcaaagaagatacatctgattttcctcaaaatatgctcaatccaaaatatacttttgatacttttgtcatcggatctggaaaccgatttgcacacgccgcttccctcgcagtagcggaagcacccgcgaaagcttataaccctttatttatatatgggggcgtcggcttagggaaaacgcacttaatgcatgcgatcggccattatgtaatagatcataatccttctgccaaagtggtttatctgtcttctgagaaatttacaaacgaattcatcaactctatccgagataataaagccgtcgacttccgcaatcgctatcgaaatgttgatgtgcttttgatagatgatattcaatttttagcggggaaagaacaaacccaggaagaatttttccatacatttaacacattgcacgaagaaagcaaacaaatcgtcatttcaagtgaccgaccgccaaaggaaattcctacgcttgaggacagattgcgctcacgttttgaatggggacttattacagatatcacaccgcctgatctagaaacgagaattgcaattttaagaaaaaaagccaaagcagaaggcctcgatattccgaacgaggttatgctttacatcgcgaatcaaatcgacagcaatattcgggaactcgaaggagcattaatcagagttgtcgcttattcatctttaattaataaagatattaatgctgatctggccgctgaggcgttgaaagatattattccttcctcaaaaccgaaagtcattacgataaaggaaattcagagggtagtaggccagcaatttaatattaaactcgaggatttcaaagcaaaaaaacggacaaagtcagtagcttttccgcgtcaaatcgccatgtacttatctagggaaatgactgattcctctcttcctaaaatcggtgaagagtttggaggacgtgatcatacgaccgttattcatgcgcatgaaaaaatttcgaaactgctggcagatgatgaacagcttcagcagcatgtaaaagaaattaaagaacagcttaaatagcaggaccagggatcaatcggggaaagtgtgaataacttttcggaagtcatacacagtctgtccacatgtggataggctgtgtttcctgtctttttcacaacttatccacaaatccacaggccctactattacttctactattttttataaatatatatattaatacattatccgttaggaggataaaaatgaaattcacgattcaaaaagatcgtcttgttgaaagtgtccaagatgtattaaaagcagtttcatccagaaccacgattcccattctgactggtattaaaattgttgcatcagatgatggagtatcctttacagggagtgactcagatatttctattgaatccttcattccaaaagaagaaggagataaagaaatcgtcactattgaacagcccggaagcatcgttttacaggctcgcttttttagtgaaattgtaaaaaaattgccgatggcaactgtagaaatcgaagtccaaaatcagtatttgacgattatccgttctggtaaagctgaatttaatctaaacggactggatgctgacgagtatccgcacttgccgcagattgaagagcatcatgcgattcagatcccaactgatttgttaaaaaatctaatcagacaaacagtatttgcagtgtccacctcagaaacacgccctatcttgacaggtgtaaactggaaagtggagcaaagtgaattattatgcactgcaacggatagccaccgtcttgcattaagaaaggccaaacttgatattccagaagacagatcttataacgtcgtgattccgggaaaaagtttaactgaactcagcaagattttagatgacaaccaggaacttgtagatatcgtcatcacagaaacccaagttctgtttaaagcgaaaaacgtcttattcttctcacggcttctggacgggaattatccagacacaaccagcctgattccgcaagacagcaaaacagaaatcattgtgaacacaaaagaattccttcaggccattgatcgtgcatctcttttagctagagagggacgcaacaacgttgtaaaactgtccgcaaaaccggctgaatccattgaaatttcttccaattcaccggaaatcggtaaagttgtggaagcaattgctgcggatcaaattgaaggtgaggaattaaatatctcttttagtccaaaatatatgctggatgcactaaaggtgcttgaaggagcagaaatacgcgtaagctttacaggtgcaatgagacctttcttaattcgcacgccgaatgatgaaacgattgtacagcttatcctccctgtcagaacctattaatccgatacactgctgccgacttgtcggcagcttttctattcggtatctgctccgacaagttttccctttccctaattcgtttttttttagtacaattagatattagtgatatttgaaagaggtcgatataatggcaaatccgatttcaattgatacagagatgattacactcggacaattcttaaaattagccgatgtgattcagtctggcggtatggcgaagtggtttttaagcgagcatgaagtgcttgtgaacgatgagccggacaaccgccggggcagaaagctgtatgttggagatgtggtagagattgaaggatttggttcatttcaagtcgtcaattaaagcgggtgacactgattgtatatccagaacttagaactgacatcttaccgcaactacgaccatgctgaacttcaatttgaaaataaagtaaatgtgatcatcggagaaaacgcccaggggaagacaaacctcatggaggcgatctatgtcttgtccatggcgaaatcgcaccggacatcaaatgacaaagaacttatacggtgggacaaagactatgctaaaatagagggaagagtgatgaagcaaaacggggcgatcccgatgcagctcgtcatctccaaaaagggtaaaaagggcaaggtcaatcatattgaacagcaaaagctcagccagtatgtcggggccctcaacaccattatgttcgcgccggaagatttaaatcttgtaaagggaagccctcaagtgagaaggcggtttcttgacatggaaatcggacaggtttctcccgtctatcttcatgatctttctctttaccagaaaatcctttcccagcggaatcattttttgaaacagctgcaaacaagaaaacaaactgaccggacgatgctcgatgttctgaccgatcagcttgtagaagttgcagcaaaagtcgtcgtaaaacgcctgcagtttacagcacagctcgagaaatgggcgcagcccatccatgcaggcatctcaagagggcttgaagaactgaccctgaaataccatacagctcttgatgtatcagatcccctagatttgtcgaaaataggagatagctatcaagaagcgttttctaaattaagagaaaaagaaattgagcgtggtgtgacgctgtcagggccacatcgcgatgatgttcttttctatgtgaacggacgcgatgtgcagacgtatggttctcaaggacagcagcgaacgacggcgttgtcccttaagctggcggagattgacctgatccatgaagaaatcggagaatatcccattttactattggatgatgtactgagtgaactggatgattatcgccagtcacacttgcttcatacgatccaaggccgtgtacaaacgtttgtcacaacgacaagcgttgatggcattgatcacgaaaccttacgtcaagcaggaatgttccgtgtgcaaaatggtgcgttagtgaagtgaagaaatgaggtgagcaattgtatattcatttaggtgatgactttgtggtttcaacacgagatattgtcggcatttttgactttaaagccaacatgtcgcctattgttgaagaatttctgaaaaaacagaaacacaaggtggtgccttccgtaaacggcacgcccaaatctatcgtagtcacggttcagaatatatattactctcccttatcttccagcacattaaaaaaacgtgcgcaatttatgtttgaaatagattcttagaaattttttatcacgaatatatcgtttagaaaagtgtaggtgaatgacgtggctatggaacagcagcaaaacagttatgatgaaaatcagatacaggtactagaaggattggaagctgttcgtaaaagaccggggatgtatatcggttcgacaaacagcaaaggccttcaccacctggtatgggaaattgtcgacaatagtattgacgaagccctcgccggttattgtacggatatcaatatccaaatcgaaaaagacaacagtatcacggttgtagataatggccgcggtattccagtcggtattcatgaaaaaatgggccgtcctgcggtagaagtcattatgacggtgcttcatgccggaggaaaatttgacggaagcggctataaagtatccggaggattacacggtgtaggtgcgtcggtcgtaaacgcactatcaacagagcttgatgtgacggttcaccgtgacggtaaaattcaccgccaaacctataaacgcggagttccggttacagaccttgaaatcattggcgaaacggatcatacaggaacgacgacacattttgtcccggaccctgaaattttctcagaaacaaccgagtatgattatgatctgcttgccaaccgcgtgcgtgaattagcctttttaacaaagggtgtaaacatcacgattgaagataaacgtgaaggacaagagcgcaaaaatgaataccattacgaaggcggaattaaaagttatgtagagtatttaaaccgctctaaagaggttgtccatgaagagccgatttacattgaaggcgaaaaggacggcattacggttgaagtggctttgcaatacaatgacagctacacaagcaacatttactcgtttacaaacaacattaatacgtacgaaggcggtacccatgaagctggcttcaaaacgggcctgactcgtgttatcaacgattacgccagaaaaaaagggcttattaaagaaaatgatccaaacctaagcggagatgacgtaagggaagggctgacagcgattatttcaatcaaacaccctgatccgcagtttgagggccaaacgaaaacaaagctgggcaactcagaagcacggacaatcaccgatacgttattttctacagcgatggaaacatttatgctggaaaatccagatgcagccaaaaaaattgtcgataaaggcttaatggcggcaagagcaagaatggctgcgaaaaaagcccgtgaactaacacgtcgtaagagtgctttggaaatttcaaacctgcccggtaagttagcggactgctcttcaaaagatccgagcatctccgagttatatatcgtagagggtgactctgccggaggatctgctaaacaaggacgcgacagacatttccaagccattttgccgcttagaggtaaaatcctaaacgttgaaaaggccagactggataaaatcctttctaacaacgaagttcgctctatgatcacagcgctcggcacaggtattggggaagacttcaaccttgagaaagcccgttaccacaaagttgtcattatgacagatgccgatgttgacggcgcgcacatcagaacactgctgttaacgttcttttacagatatatgcgccaaattatcgaaaatggctacgtgtacattgcacagccgccgctctacaaggttcaacaggggaaacgtgttgaatatgcgtacaatgacaaggagcttgaagagctgttaaaaactcttcctcaaacgcctaagcctggactgcagcgttacaaaggtcttggtgaaatgaatgccacccagctatgggagacaaccatggatcctagctccagaacacttcttcaggtaactcttgaagatgcaatggatgcggacgagacttttgaaatgcttatgggcgacaaggtagaaccgcgccgaaacttcatagaagcgaatgcgagatacgttaaaaatcttgacatctaatcataaaaagccttatttccaataagaaataaggcttttttctgaacaagatcagatgcagcaatgcttgcaatacctatatattctagcaatttaatgtgtataatcataagtttattgatataatggagaatagtgaaatcgtattgaaggtcataatggacaatctactcccacatatttcatgtgatacttcagggaggttttttaatgagtgaacaaaacacaccacaagttcgtgaaataaatatcagtcaggaaatgcgtacgtccttcttggattatgcaatgagcgttatcgtgtcccgtgctcttccggatgttcgagacggtttaaaaccggttcatagacggattttgtatgcaatgaatgatttaggcatgacaagtgacaagccttataaaaaatccgcgcgtatcgttggagaagttatcgggaaataccacccgcacggtgattcagcggtatatgaatccatggtcagaatggctcaggatttcaactaccgttatatgctcgttgacggtcacggaaacttcggttctgttgacggagactcagcggcggccatgcgttatacagaagcaagaatgtctaaaatctcaatggagattcttcgcgacatcacaaaagacacaatcgattaccaggataactatgacgggtcagaaagagaacctgtcgttatgccttcaaggttcccgaatctgctcgtgaacggtgctgccggcattgcggtaggtatggcaacaaacattcctccgcaccagttgggagaaatcattgacggtgtacttgctgtcagtgagaatccggacattacaattccagagcttatggaagtcattccagggcctgatttcccgactgcgggtcaaatcttgggacgcagcggtatccggaaagcatacgaatcaggccgaggctctatcacgatccgggcaaaagctgagatcgaacaaacatcttcgggtaaagaaagaattatcgttacagagttaccttaccaagtaaataaggcgaaattaattgagaaaatagctgatctcgtaagggacaaaaagatagagggtatcacagatctgcgtgatgagtcagatcgtacaggtatgagaattgtcattgaaatcagacgcgatgccaatgcgaatgtcatcttaaacaatctgtacaaacaaactgctctacaaacatcttttggcatcaacctccttgcacttgttgatggccagccgaaagttttaactcttaagcaatgtttggagcattaccttgaccatcaaaaagttgtcattagacgccgtactgcttatgaattgcgtaaagcagaagcgagagctcatatcttggaaggattgagagttgcactggatcatctcgatgcagttatctcccttatccgtaattctcaaacggctgaaattgcgagaacaggtttaatcgaacaattctcactgacagagaagcaagcacaagcgatccttgatatgaggctccagcgtttaacgggactggaacgtgaaaagatagaagaagaataccaatctcttgttaaattaattgcagagctaaaagacatcttggcaaatgaatataaagtgcttgagatcattcgtgaagaactcacggaaatcaaagagcgttttaacgatgaaagacgtactgagatcgtcacttctggactggagacaattgaagacgaagatctcatcgagagagaaaatatcgtagttactctgacgcacaacggatacgtcaaacgtcttcctgcatcaacttaccgcagtcaaaaacgaggcggaaaaggtgtacaaggtatgggaacaaacgaagatgatttcgttgaacatttgatctctacgtcaactcatgacacaattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttaccttttcttcactacaaagcatggggtttcaaaacgaacatcgctatctcaattcgctaatatccgcaacaatggtctaattgctctgagtcttcgtgaagatgatgaactgatgggtgtacgtctgactgacggcacaaaacaaatcatcattggaacgaaaaacggtttactgatccgtttccctgaaacagatgtccgggagatgggaagaactgcggcgggcgtaaaaggcatcaccctgacggatgacgacgttgttgtcggcatggagattttagaggaagaatcacacgtccttatcgtaactgaaaaagggtacggaaaacgaactccggctgaagagtacagaacccaaagccggggcggaaaaggactcaaaacagcgaaaatcaccgaaaacaacggccaactagtagcagtgaaagctactaaaggtgaagaggatctaatgattattacagctagcggcgtactcatcagaatggacatcaatgatatctccatcaccggacgtgtcactcaaggtgtgcgtctcatcagaatggcagaagaagagcatgttgctacagtagctttagtagagaaaaacgaagaagatgagaatgaagaagaacaagaagaagtgtgagaaaaagcgcagctgaaatagctgcgcttttttgtgtcataaccctttacagtcataaaaattatggtataatcatttctgttgtcttttaaaagacacaaacatgaccattatgactagtaaaaactttttcaaaaaagtattgacctagttaactaaaaatgttactattaagtagtcgcttcgagagaagcacacaaagttctttgaaaactaaacaagataaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctttacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatattgttgaatgatgtcacacctgttatctagttttgagagaacactctcaatttgtttggtggcgatagcgaagaggtcacacccgttcccataccgaacacggaagttaagctcttcagcgccgatggtagtcgggggttccccctgtgagagtaggacgccgccaagcaagcttaaacccagctcattgagctgggttttttgtttgtcaaaaatgaagaagaaactgtgaagcgtatttagggaatttcttttctgatactagtaaaaactgctgaattaacacgtagtcatcacttatatgctgtgttaataactcataccaccattctgtttcataccttgcaatcatcccaacgttgtacaaaatcaaataatgaattgtcatttcgggaagcctcagaaattgctccctttgagaagggatataatattggttcttttccatgtcaaacaataagctggtcgatgtccatggctctttgtcttgtggtgaaatttcgaacagcagcccttgttcatttttttttgtgaaagaccattgataatgatgggacatgtattcagcaaaccttgaatcagacattttgtaattgattactacttcctccggtacaaaaatttcgttcttatccttctcaacttttgttataaatcgttctttctgctgaaagtagaaaatatcgctaagttctggaatggccattaataattttttcatggtataccgttcatctactatatccgattgtccgaataaatgtttcataaaatgtacgcataggccattccgttgtattttcacttcatcatcgctaaaacaataattttgtttctttcgttttcttgttgttacgccatgtgccagtaccgatgtatggcttggataatgaggatcacgtgtaattaagcatgctttgataagctgtgccattccataaaataaaagaatcggtttgatttctaagggagaatatgcggcttgtttataaaacgattcggcatgctttaagaaataaataaaccgttcactgtttttaaaagagttttttttcgcatcgtcaataccgtttaaggtataaaccttttctagaaatttctgggttgattcaacggagtaaaatagcgctaagtctttccactcatgatatgtcatgtatatttcttaatcctttccgttatctaaatatttcaactctttcccgcttccttgacatgctcttggctagttgataatctacatataatattttgccgaaaagagggggatttactaatgtgggaaagtaaattttcaaaagaaggcttaacgttcgacgatgtgctgcttgtgccagcaaagtctgaggtacttccgcgtgatgtggatttatctgtagaacttacaaaaacgttaaagctaaatattcctgtcatcagcgcaggtatggacactgtaacagaatcagcaatggcaattgcaatggcaagacagggcggcttgggcatcattcacaaaaatatgtccattgaacagcaggctgaacaagttgataaagtaaagcgttctgagcgcggcgttatcacaaatcccttctttttaactcctgatcaccaagtatttgatgcggagcatttgatggggaaatacagaatttccggtgttccgattgtaaataacgaagaagaccagaagcttgttggaattattacaaaccgtgacctacgttttatttctgactactcaatgaaaatcagcgatgtcatgacgaaagaagagctagttactgcatctgtaggaactactctggatgaagctgaaaagattttgcagaaacataaaattgaaaagcttcctctcgtagacgaccagaataaattaaaaggtcttatcacaattaaagacattgaaaaagtcattgagttcccgaactcatctaaagacattcacggccgcctgatcgttggtgcggcagttggtgtaactggcgatacaatgactcgcgtcaaaaagcttgttgaagccaatgttgatgtgattgttatcgatacagctcacggacactctcaaggcgttttaaacacagtcacaaaaatccgtgaaacgtatcccgaattaaacattattgctggaaacgtggcaacagctgaagcgacaagagcgcttatcgaagctggagcagacgttgtcaaagttggaataggacctggttcaatttgtactacacgtgttgtagccggcgtcggtgttccgcaaattacagcaatttatgattgtgcgactgaagcaagaaaacacggcaaaacaatcatcgccgacggtgggattaaattctctggcgatatcactaaagcattggcagccggcggacatgctgttatgctcggaagcttgcttgcaggcacatcagaaagccccggtgaaactgaaatctaccaaggcagaagatttaaggtataccgcggcatgggatcagttgctgcaatggaaaaaggaagtaaagaccgttacttccaagaagaaaacaaaaaatttgttcctgaaggaattgaaggacgcacaccttacaaaggaccagttgaagaaaccgtttatcagctagtcggaggccttcgttctggtatggggtattgcgggtccaaagatctgcgtgcgctaagagaagaagctcagttcattcgcatgactggcgcaggacttcgcgaaagccatccgcatgacgtacagattacaaaagaatcacctaactatacaatttcataataaattgttacaaattaaaaacatttgacagggtctctgactctgtctattttttttatactgattatgataaaatttatactgttgtgcattgaaaatgtccttaacggcttaattatagatgaagaaaatgaaatacggaggtcgtacgattgaacatcaagaaatgtaaacagctactgatgtcattggttgtgttaactctagctgtcacgtgtctggctccaatgtcaaaagcaaaagcagccagcgatccaattgatatcaatgcatctgctgctattatgatcgaagcttcttcaggtaaaattctttacagtaaaaatgcagataagagactgccaattgcgagtatgacaaaaatgatgacagagtatctgttattagaagcaattgatcaaggtaaagtgaaatgggaccaaacctatacgcctgatgactatgtgtatgaaatttcccaagataacagcttatcaaacgttcctcttcggaaagacgggaaatacacagtaaaagaattatatcaagctacagcaatttattctgcaaatgctgctgctattgcgattgcagaaatcgttgccggttctgaaactaagtttgttgaaaaaatgaatgcaaaagcaaaagaactaggcttaacagattacaaatttgttaacgcaacaggtcttgaaaacaaagatcttcacgggcatcagcctgaggggacaagcgtaaatgaagaaagtgaagtttctgcaaaggatatggcggttcttgcggatcacttgattactgactaccctgagatactggagacttccagtatcgccaaaacgaaattcagagaaggcaccgatgatgaaatggacatgccgaactggaattttatgctgaagggacttgtcagcgagtataaaaaagcgactgtagacggactgaaaacgggttctactgactctgcgggttcatgctttacaggaacagctgaacgcaacggtatgcgtgtcatcactgttgttttaaacgcaaagggcaaccttcatacaggccgtttcgatgaaacgaaaaaaatgtttgattatgctttcgacaatttctccatgaaagaaatttatgctgaaggcgatcaagtaaaaggccataaaacagtttcagttgataagggtaaagagaaagaagtaggcattgtgacaaacaaggcgttctctcttcctgtcaaaaatggtgaagaaaagaattacaaagcgaaggtcacactgaataaagacaacttaactgctcctgtgaaaaaaggaaccaaggttgggaagctgactgcggaatacacaggtgatgaaaaggattacggattcattaacagcgatctggctggcgtagaccttgttacaaaagaaaatgtagaaaaagcaaactggtttgttttgacaatgcgcagtatcggcggattttttgccggaatttggggaagcattgttgatacggtaaccggctggttttaatcaattgaaagagctctgatggaagttagggctctttcgcgtaatatactgaaaaaacccaatttttaataaaaaatgattttcaaagcgctaaaaaccgaataaaatagtatatatccatatgaattattggatttctaggatacaataaggattagaaatcatataactataccttgattagggggaccaagaaatggctcaaacaggtactgaacgtgtaaaacgcggaatggcagaaatgcaaaaaggcggcgtcatcatggacgtcatcaatgcggaacaagcgaaaatcgctgaagaggctggagctgtcgctgtaatggcgctagaacgtgtgccagcagatattcgcgcggctggaggagttgcccgtatggctgaccctacaatcgtggaagaagtaatgaatgcagtatctatcccggtaatggcaaaagcgcgtatcggacatattgttgaagcgcgtgtgcttgaagctatgggtgttgactatattgatgaaagtgaagttctgacgccggctgacgaagaatttcatttaaataaaaatgaatacacagttccttttgtctgtggctgccgtgatcttggtgaagcaacacgccgtattgcggaaggtgcttctatgcttcgcacaaaaggtgagcctggaacaggtaatattgttgaggctgttcgccatatgcgcaaagttaacgctcaagtgcgcaaagtagttgcgatgagtgaggatgaactaatgacagaagcgaaaaacctaggtgctccttacgagcttcttcttcaaattaaaaaagacggcaagcttcctgtcgttaactttgccgctggcggcgtagcaactccagctgatgctgctctcatgatgcagcttggtgctgacggagtatttgttggttctggtattttcaaatcagacaaccctgctaaatttgcgaaagcaattgtggaagcaacaactcacttcactgattacaaattgatcgctgagctgtcaaaagagcttggtactgcaatgaaagggattgaaatctcaaacttacttccagaacagcgtatgcaagaacgcggctggtaagaacataggagcgctgctgacatgttaacaataggtgtactaggacttcaaggagcagttagagagcacatccatgcgattgaagcatgcggcgcggctggtcttgtcgtaaaacgtccggagcagctgaacgaagttgacgggttgattttgccgggcggtgagagcacgacgatgcgccgtttgatcgatacgtatcaattcatggagccgcttcgtgaattcgctgctcaaggcaaaccgatgtttggaacatgtgccggattaattatattagcaaaagaaattgccggttcagataatcctcatttaggtcttctgaatgtggttgtagaacgtaattcatttggccggcaggttgacagctttgaagctgatttaacaattaaaggcttggacgagccttttacaggggtattcatccgtgctccgcatattttagaagctggtgaaaatgttgaagttctatcggagcataatggtcgtattgtagccgcgaaacaggggcaattccttggctgctcattccatccggagctgacagaagatcaccgagtgacacagctgtttgttgaaatggttgaggaatataagcaaaaggcacttgtataaaacagttgaaagctgtggaaacttatagtacattataagcacaaataaagatcgaaaagcgttgataggaactagtagggagcctctctttctaagagagccgatggttggtgcgaatcggtgaaagatgctgtctgaatccatccttgagcgaaatgctgaaacaagtaggcatttacgggataaccgttatgtttgaaagtggaaaacgagtctttgatttgttttcaatcagggtggcaacgcgagagctctcgtccctttatggggatgagggctctttttattttcgacaaatcaataaaaaaaggagtgtttcgcatgcttgatacgaaaatgctgagagcaaattttcaagaaattaaagcaaagcttgtacacaaaggcgaagacttaactgattttgataagtttgaggcgctggatgatagacgaagagagctcatcggcaaggttgaagagttaaaaggaaaacgaaatgaagtttctcagcaggtcgctgtgctgaagcgtgagaaaaaagacgcggatcacattattaaagaaatgcgtgaagtcggcgaggaaattaaaaagcttgatgaagaattacggacagtggaagctgagcttgatacaatcctgctctcaatcccaaatattccgcatgagtctgtacctgtcggtgaaacagaagacgacaacgtagaagtgcgtaaatggggtgaaaagccttcattttcttacgagccgaagccgcactgggatattgcggatgagctgggcattctggattttgaacgtgctgccaaagtaacaggaagccgtttcgtgttctataaaggcttaggtgctcgtctggagcgtgcactttataactttatgcttgatctgcatgtggatgagtataactacactgaagtgatcccgccatatatggtaaaccgcgcaagcatgacgggaacggggcagcttcctaaatttgaagaggatgcatttaaaatcagagaagaagattatttcttaattccaacggcggaagtgccgattacaaacatgcatcgcgatgaaatcctttcaggtgacagcctgccgatcaactatgcggcattcagtgcttgcttccgttctgaagctggttcagcaggacgtgacacacgcggattaattcgtcagcaccaatttaataaagttgagcttgtaaagtttgtgaagcctgaagattcttatgaagaattagagaaacttacaaaccaagcagaacgggttcttcagctgcttgagcttccataccgtgtcatgagcatgtgtacgggtgacttaggctttacggctgcgaaaaaatacgatatcgaagtttggattccgagccaagacacatatcgagaaatttcttcttgcagcaacttcgaagcgttccaggcgagacgtgcgaatattcgtttcagacgtgaagcgaaaggcaagcctgagcatgtacacacactgaacggttcaggactggcggttggaagaacagttgccgctatattagaaaattatcagcaggaagacggaagcgttgtgattccgaaagtgcttcgtccttatatggggaatagagaagtaataaaaccgtaaattatggaaaggcgtgcctgacaaggtgcgcctttttgcttatgtaaacatggcattttcataaaaacaaaaaaagtttttaaaaatgcttgaccacacgagaacatacgtgatatagtaagtcttgtcgatacggaggaatacccaagtccggctgaagggatcggtcttgaaaaccgacaggggtgtcaaagcccgcgggggttcgaatccctcttcctccgccatattgattttaattctaatgaaacacaagcatatattggagattgttttgtccgttgcattcggtgcggcggattttttattttaaagaaaaagtgaatctcgactgagattcactttttttgattatcatgaataactgaagcaatttgatctacaatattttcaatcgagttttcgtcgttcagaagatcataatcttcaatgcgaagttttaaaacaggacaggcattaaaaccgcttatccagttctcgtagcgtgtatgcatttcttcccaataagacctgcttgtctgaagctccatctcacggccgcgttgttcaatccggtttaaaatgttctccagatctccttctaaatagatcaacacatctgggtgtgggaaatacggtgtcatcaccattgcttcgaaaaggcttgtgtaagtcttataatcaacctttgacattgtccctttatcagcatgcatttttgcgaaaattcctgtatcttcataaatcgaacgatcctgtacaaaacctccgccggcttcaaaaattgttttctgttctttgaagcgttcagctaagaagtaaatttgaaggtgaaagctccaacgttcaaaatcatgatagaacttttccaagtatggattatgatcgacttcctccaaagatgttttaaatccaagccgtttagctaaagtttttgttaaagtcgattttccgacacctactgttcctgctactgtaataattgaattcttagggatatgatgttccttcatacgataagctcctttacatgggcggcaatgcgttcaaagtcgctcttattcaaaacgaaatcctttgaatcaccatctacggttaacactgtaagttcagggtctgcttcctgcagctgcttgatggcgacttcataatctgaaatcagctgctccaaatagctagtttcaatttttttctcaaaggggcgtccgcgtttttcaatgcggtgtagcaatgtaggcagactggcctttatgtaaatgatgaaattcggctttggcagatcatccgttagcaggtgatatatctttttgtatttttccagctgatgtggagacaaggtgcgttccgcaaaaatcacatttttataaatatgataatcagctattacaggctgtcccttttttaaaaagtgatcactggtgtcttcaagctgtttgtatctgtgacaaagaaaaaacatctcgagctggaagctccattcctctatattgtcataaaacttatcaaggtacgggttatcctctacaatctcattgatcatagggaatccgaactcttgtgagagcatcgttgcgagagttgtttttcctgccccgataggaccttctattgcaataaaaggggctgtattcatcggaatcctccttatatctgaaaaacgtgcgtcagttaccgaccttcatattgtatcacaacccttgggtgcccccatgaaaaaaagacgtttccaaattatcgaaacgtctttttgacaacattaaattgatcagacagcagcagccagttttgtggaaaggaaagacccagcttccaatagctgatgcctcttaaattcagctctttaatcaaattgaattttgcttgaatcgagcgggcatcctcgaaccatacctcgtgccttctgttttctgcatcagtatagcggaagaaaggagcttgagcggtttggtcatactgaatggaagcattgttctgatcagctatgacaatggcttgctgagggcttactgctcttgctggagttccccctgctgtatatggcagcgtccagtcatatccatataaattctggcccatgacaattttgttcgcaggcatttcagtcaaagcatattctatgacatcacggacaggtccaattggagaaaccgcttgaggcggcccgccgctatagccccattcatatgtcatgagaacaacaaagtcgacaatttggccatgtgccctgtaatcatgagcttcataccatctgccctgctgtgttgcacttgttttaggagcaagagccgtagaaatttctaagccctctcgatgaaaaagatcccttgcttcgcggaggaattgattataggcctctctatcctggggccgcaaatattcaaagtcgaaatgaatgtcacggaagccatatctcttggcattctccactatttcatttagaagccttctttttacagtttcgtcgttcaaaaggatccggccaagttcatcgctaaatgcctggttttctaggttcgttataatcatcatcaatgttgtattttgactttctgtaatgctccttaaattcgttaaaggcggtgcgactaaggttccgttacgctgtgcctggaagctgaatgcgccaaggtacgttaagtagggtgacgcttctctggccgcctgctggagattttggctgacttgatttcctcggggctccaaataagcatttgattcgatgtctcgtttaggggctggtgggatgtataaacggaaaccaatctgaagcacggtatttaactggatgcggttaacccttgcgagctcggctgccgttgtattgaactgccgggcgatggatgtcagggtatcacctcgcttcacatcatagaactggccagctattggaatgacaatggtttgtccgacaacaaggctgtcgggattcggtatttcattcgtttcagtgatctcacttacggttgttctgtattgtgaagcgatagcagaaagagtgtcgccttgttttaccacataaatttgaatgaaaaacgcctcctttcatatcgctatcaatgtatgaaagaaaagcgctgatcatgtttatttttctgtaatttgttcttccgtcgtaatttctgcgaaaagaacattctccatcatagttaaggcgaattcgttatcttcgtcactgtttgacgcgatacagtccttaggaatcgtgatgctgtattccctcatataagcgtcattagcggtaaacagcacacatatattgccggctatacctgttaagataatatgtctcacctgcaactcagtaagaagggtgtgaagtgcagtttcgtagaaagcggaatgttttggtttgattaaaaaataatcagcatcttccggggctatctttgtgatgatatccttgcttctttcatttgtgcattcttgctgaatgtttttaatgtcagcttgccaaagtccataatgatcattgatgtaaataatcggccattcattttgtctcgcgtgctcctttaatgataaaatatgaggaacgattttttctgtttttttagcgagggtttctcccatatcgaattcaaaattattgatcatgtctacaatgagaagggctgtatctgctttggacaatcgacagtctcctttccgtttcagttatagttaatatgtagcctttttaggcaatgaaaaaactttgaaaagagagcttatccttatgacacaagatgaactttatatgaaagaagcaattaaagaagcgaaaaaggctgaagagaaaggtgaagtgccaataggtgcggtgcttgtcgttaatgatgaaattatagcgcgtgcacataatttaagagagactgaacagcgatctattgctcatgcagaaatgcttgtaattgatgaagcgtgtaaggcactcggaacatggcggctggaaggtgcgactctttatgtgacgcttgagccttgtccaatgtgtgctggtgcagtcgtactttctcgagtggaaaaagtggtttttggcgcatttgatccgaaaggcggctgttcaggcacgctaatgaaccttcttcaggaggaacgctttaatcatcaggctgaagtggtgagcggtgtacttgaggaagaatgcggcggaatgctcagtgcgtttttcagagaactaagaaaaaagaagaaagccgccaggaaaaacttgtctgaatagtacggttgcaatttttaggggaaacagatatacttaagtgtgcatcgtaatagatgcaatataaaatttgatatttattttgccgtgctaagcggggaggtagcggtgccctgtacctgcaatccgctctagcagggccgaatcccttctcgaggttcgtttactttaaggcctgccttaagtaagtggtgttgacgtttgggtcctgcgcaatgggaattcatgaaccatgtcaggtccggaaggaagcagcattaagtgaaacctctcatgtgccgcagggttgcctgggccgagctaactgcttaagtaacgcttagggtagcgaatcgacagaaggtgcacggtaaatcaatcatcaaattttcagactcacctaacattaggtgagttttttgttatgtaaaaagagcttttggaatcgaaacaaggttcatgtataatgggaatgatgaataacggaggagggcaaacccgtgagttaccaagctttatatcgagtattcaggcctcagcgctttgaagatgtggtcggacaagaacacattacaaaaacgctgcaaaatgcccttttgcaaaaaaagttttctcacgcctatctgttttccgggcctagaggaaccggaaaaaccagtgcagccaaaatatttgctaaggctgtcaactgtgaacatgctcctgttgatgagccatgcaacgaatgtgcggcctgtaaagggataacaaacgggtcaatatccgatgtcatagaaattgacgccgcttctaataacggtgttgatgagattcgtgacattcgcgataaagtgaagtttgccccatcggccgtcacatataaggtatatatcatagatgaggtgcatatgctttctatcggcgcttttaatgcattactaaaaacattagaagagccgcctgagcattgtattttcatattagcaacaactgaaccgcacaaaattcctttaaccattatctctagatgtcagcgttttgactttaaacgaattacctcccaagcgattgtaggccgcatgaataaaattgttgatgctgaacagctacaagtggaggaaggatcgctggatatcatcgcgagtgctgcagacggagggatgagggatgccctgagccttcttgatcaggccatatcattcagcggcgatatcctgaaagtcgaagatgcgcttttaattacgggtgctgtttctcaattatatatcgggaagcttgcaaaatccctgcatgataaaaacgtttctgacgcactggaaacattaaatgaattgcttcagcaaggaaaagatccagctaagctgatagaagatatgattttctatttcagggacatgctgctgtacaaaacagcccctggcttagagggagtgcttgagaaagtaaaagtcgatgaaacgttccgggaactaagtgaacaaattccggctcaggccctatatgaaatgattgatattctgaacaagagccatcaggaaatgaaatggacaaatcatccgcgtatctttttcgaagtggccgttgtgaagatttgccaaacctcacatcaatctgctgctgatctcccggaagtggatatgctgatgaaaaaaatccagcagctcgaacaggaagtagagcggctcaaaacaacgggcataaaagcagctgcggaaagcccgaaaaaagaagcgccgcgtgtgccaaagggcgggaaatccaattacaaagcgccagtaggcagaattcatgagattttgaaggaagccacaagaccggatcttgatctgctcagaaacagttggggcaagcttcttgctcatctcaaacagcaaaacaaagtatcacatgccgctttgctgaatgacagtgaacctgtggctgccggatcggcggcatttgttctgaaattcaaatatgaaattcattgtaaaatggtcgctgaggataacaacggagtccggactaatcttgagcagattttagaatcgatgctcggaaaaagaatggatttgattggcgttccagaagcacaatggggtaaaataagagaagaatttttagaagatcatcagcaggaaaatgaaggatcaaatgaaccggctgaagaagacccgcttattgccgaagcgaaaaagcttgttggagcggatttaattgaaataaaagactaacaaaatgaaagagagtgaatgctatgcgtggcggaatgggtaatatgcaaaaaatgatgaaacaaatgcaaaaaatgcaaaaggacatggcgaaggctcaagaagagcttgcagaaaaggttgttgaaggaactgcaggcggcggtatggtaacagtaaaagcaaacggccaaaaagaaatcctggatgttatcatcaaagaagaagtcgttgatccagaagatattgatatgcttcaagatttagtgcttgctgcaacgaatgaagctttgaaaaaagttgacgaaatcacaaacgaaacaatgggtcaatttacaaagggaatgaacatgccaggtttattctagggggataaaagaacatgcaatatcctgaaccaatatcaaagctgattgacagctttatgaaattgccagggatcggaccgaaaacagcggttcgtctggctttttttgttctaggtatgaaagaagatgtagtattagattttgcgaaagcattagtaaatgcgaaacgcaacctgacatattgttcagtttgcgggcatattacagatcaggacccttgctatatatgtgaagatacgcgcagggataagtctgttatctgtgttgtgcaagaccctaaggatgttatcgctatggagaaaatgaaggaatacaacggacagtatcacgttcttcacggcgctatttctccaatggacggcatcggaccggaggatattaaaataccagaattgttaaaacgattacaggatgatcaagtgacagaagtgatcctcgcgacaaaccctaatatagaaggggaagcaacggcgatgtatatatcaaggctcctcaagccgtctggtattaagctctcccgtattgcccacggactgcccgtcggcggtgacttggaatatgctgacgaggttactctttctaaagcacttgaaggaagacgtgaattgtaaggaggaaaaagcgatccatgggttttcttcgcaagaaaacattaagaagagagtttgatgaaaaactaaccgagcagctttttaagcaaaaggaagagtggaacaggcaaaaaaagctggttgaaaaaagcttagaaccgtctgctgaagtgttatacgaactgaaagtagctgaagcgaagtattttttttacttaagggaagcgaagcagcgaaatttaaaaatcagccggtggaagtaagtggtctaaactcctggatcttctcataagcttgtactagaacaagcgaaggagatgagaagattcatggagcctatttttattattgggattattttaggactggttattcttctttttttatcaggttcagctgcgaagcctttaaagtggatgggcatcacagctgttaaatttgtggcaggtgctttgctgctggtttgtgtaaatatgtttggcggcagtcttggcattcatgtgccgattaatctggttacaacagctatcagcggaattttagggatacccggaatagctgcgttagtcgttattaagcaatttatcatttaattgatattatgtattgacttagacaactgaaggtgttattctaatatacgtcgctgatgacgaacagcttttttgaaaagaaaatattaaaaagttgttgacagtagcggcggtaaatgttatgataataaagtcgcttaaacgagcggtaaacaaagttctttgaaaactaaacaagacaaaacgtacctgttaattcattttttataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttaggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatattgttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgtttactcaagatcgagaaaatcaaacaaatacaaacaccgagggcttatatagcccatatactgatttgaagtttcaaaaagatctaaatagtgtatacaatatctgttttaaggggaggctaattgtacggaggtggagaagatggacgaaacaggcaaacttaatcatacatgtgtgatttgtgatcaagagaagaatagaggcattcatctttatacgaaattcatatgcttagattgtgagagaaaagtaatttctacatcaacttctgatcctgactatgcgttttacgtaaaaaaactaaagagcattcatacaccgccattatattcatagacctgaaaaggtctttttttgtactcttaataataaaaagaagatgaaacttgtttaaggattgaacgtagtagataataatattaaaactgagtatagacacaggagtcgattatctcatgcagagattttttcactttttgatgtggagtttaactagcagtgcgacttttgttttcataggaatattgagctttttcggtttaaaccagtcgctttttttatcttttgtttatgggcttgcttctggagcagccgtatatacagctggcatctggaatgcaagacggttatttcttaaaaagcatgaattgacaggaagagagtatgcttacattaagaaaaacttagaggaagcaaggcagaaaatgatccgtcttagaaaagccttgtttcaggctaaaagcattcaaatgtttaagcaaaatgcagaaatgctaaggattgtgagaaggatttatctcctcaccaaaaaagagccaaagcggttttatcaggcagaacgatttttttatcaaactctcgattcggttgttgaattgacagagaagtatgcttttctatcatctcacccaaaaaaaagcaaagaactgtcgatgtcgttaagtgagacacgcatcactcttactgaattgaacaagcgtttagaggaagatttaactcaagtaatgggtgatgaaattgacgagttgcagtttgaattagacgcagcaaaacattcattaaagaaataagggaagagggtaagagcgatgaaccgagaccaaagcgaccttcatatagatgaattattggcagatccttttggtggtaacatagagataccaggttcggaggctgtaaaagcagagaaagagcaagtacggcttgttgatgttcttcctgaggaaaacaaggaaaaagcaattcagcttgctggacagattgatcataaaaatatgcaaagtattgtcttatacggttcacaagctcaatctaaactgctgaacttttctcatgatatgattaatcatgttcaaaagaaggatgtcggggagattggcgaaatacttggagagctgatgaaaaagctggagcaagtaaatcctgatgatctccaatctaagaaaaagggttttttggcacgcatgtttggaagagtatcaagttctcttcaagaggtgctgtctaaataccaaaagaccagtgtgcagatagacagaatcagcttgaagctggagcactctaaaaatgctttaatcagtgacaacaagctgttagagcagttatatgaaaaaaataaagaatattttgccgcgctgaatgtttatattgctgcaggagaactgaagctggaggaattaaaaacaaaaacgattcctgaactgaagcaacaggctgaatcgagtgatcataaccaaatggccgttcaagaggtgaatgatttaattcaatttgctgaccggttagataaaagggtgcatgatttgctgctgagcaggcaaattacaatccaaagtgcaccgcaaatcaggctgattcaaaatacaaaccaagcgttagctgaaaagattcagtcatccattgtgacagcgattcctctatggaaaaatcaagttgccattgcactgacgcttttaaggcagcgcaatgcagtggatgcacaacagaaagtatctgatacaaccaatgagcttttgttgaaaaatgcggagcttttaaaaaccaatacaattgaaactgcacgggcaaatgaacggggcctggttgatatagataccttgaagaaggttcaggaaagcttaataagcacgcttgaagaaacactgactatacaagaagaaggacgaatcaaacgccgtcaggcagaagaagagcttatgatgatggaaggcgacctgaagcaaaagctgcttacaataaaggaaagatagttaccagtaagtctggctttaagttctctcagaggcacgatataataaggtgtaagaagacacattcaaaggattgttttcatgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggattggatgatctccatcatccttctggggtgattaaggaagctcaggagcttgccagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttggccggtgctgagccggtttatcttgcacctgacgttgattcagcgatgcatgtgcctacgcatgttccgcttggaacaattaaagaggccctggcagcacatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgcctgccatgacgatgggttcttatttgcatctcaacagcagctgcaggattaacagggatcgggttgcagagtatttaaaccgattacaaagcagcagcccgtcttatccgattatggcttcgttagatattgcccgcgcttatgtacagcatattatagaagaacaaaagctttctgacattctgcagcggatacaaacacttaaacaaacgtttgattcacttacaaatgcagaagctgttaaccctgctaatccactgatcatcacggatccgctaaagctcacaattcgttcaaaacgcgggcattctggctatacgctgcaaagcattttagagcgtgccaacatattcactgagcttgctgatgaaaatcaagttctgctcgttctcccattgggaggaaaacggagaataaacgctgaaaccattagaagcatcgatgaagagattgagaaaacgcctccggatcagacgtttgtttctgcagaatggggtgtgcagcctgttactgtcttgccttatccaaaaaaggtcttacattcgtttaagaaagaatatgtggactttgaggaagcagctggccggctgaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatgagcggtttatttattacattcgaaggtcctgaaggtgcagggaaaacgactgttctgcaggagatcaaaaacatactgacagcagaaggccttcaggttatggcaactcgagagccaggcggaatagatattgcagaacaaattcgagaggttattctgaatgagaacaatacattaatggacccaaaaacagaagctctcttatatgcggctgcaagacgccagcatttagttgaaaaagtaaaacctgctttagaacaggggtttatcgttctttgcgacagattcatagacagttctcttgcgtatcaaggatatgcaagagggcttggaattgatgaggttctgtccattaatgaatttgccattggagatatgatgccccatgtaacggtttatttttcaattgatccggaagaaggcctgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtaatcgatgaagcgttgaaaaaaattcaattgtgacctgtttcccaatagttgatataataatgtaaacgagatcacgttgtttccaatctaaaggaggccttcacagatgaaattgatagtggcagttgtacaagatcaggacagcaacagacttttgaaaaccttaacggatcacaacttcagagtcacaaagcttgcgacgacaggaggatttcttaaatcaggcaatacaacgtttatgatcggtgtcgaggatatacgcgtcaataaagcgttgagtctcattaaagaaaacgggcagaaacgtgatcagatgattgcccctgtatctccaatgggcggaaatgctgattcttatgtcccttatccagtcgaagttgaagttggcggagcgacagtatttgtccttccagtcgatgaatttcatcaattttaaggatctgaaactgtgaaaattaataaagatatacgtacatttatagataataagcagattccctctgtgaaaacatcagagatcacagcatcgtttaaaacatcaatggaaaaccaaagcagcaaaatgaagcttgatcagcttaccaggctgttatctgatatagaggcattcggaaaaaggctaacgaaatctcggaattttaaagacttagcgagatttaaaggacttgtgaaacgttttgtcaaagaagctgtggacagcggtctttcacatgaaacatcgaaaagctttgacctttacgggaacagcagaacgctgggacttgtgaaagaaatagatgacaaattgatacagcttacggaagagatgatggatcaggaaaaaccggcaattgatttgctggagcgtattggcgaaataaaaggtttattaattaacctttacacatagagagtgatacaatggcaatatcctggaaggaaatgaacgagcttcagcccagagtgatgaagcttttatataatagtattgagaaggacagactatcacacgcttatttgtttgaggggaaaaaaggaacaggcaagcttgatgccgcgctgcttcttgcaaaaagcttcttttgtctggaggatggcgcggagccttgtgagagctgccgaaactgtaaacggatagagtcagggaaccatcctgatctccatcttgttcagcctgatggcttatcaatcaaaaaggcgcaaattcaagcgctccaagaagagttttctaagacaggacttgaatcgcataaaaagctgtatattatttcgcacgcagatcaaatgacagcaaatgcggcgaacagcctgctgaaatttttagaagaaccgaacaaagacacaatggccgtcctcatcactgagcagccccaaaggttattggataccatcatttcaagatgccaaacccttccttttcagcctttgcagccgaaagcaattgaagacagactgatcgaacaggacgtctcgcctcatatggcaaggcttctggccaacatgactaataatgtagcagaagcagtcgaattaagtcgaaatgatgagtttgcagagtctagagcgaaagtgataaaattgtatgaagtcctacaccagcggaaaggacatgcttttttctttattcaagatcaatggatgccctttttcaaagaaaaaacccatcaagaaatgggtcttgatatgctcttattgatatatcgtgatgtgttgtccatccaaataggaaatgaagataaattgatttatcaagacttattccaatcaataaaacagcatgcgctacaatcaacacaacaaagcgttacgaatcagatacttgctgttttagaagcaaagaaacggcttcattccaatgtgaatgtacaaggattaatggagcacttggtgttaatgttgcaggagggataagcttgtacaatgtaattggtgtccgctttaagaaagcgggtaaaatatattattttgatccgaatggatttcatatagaacatgacagctgcgtaattgtagaaactgtcagaggagttgagtacggccaggtcgtaattgcaaataaacaggtggatgagcatgatgtggtgcttccccttcgaaaagtgatacgtgtggctgacgagcgcgatcttctcattgtagaagaaaataaacaggaagcactatcagcatttgatatctgccaaaagaaagtgattgagcatggcttggatatgaagctggtcgatgttgaattcacgtttgatcgcaataaagtcattttttacttcactgctgacggccgagtcgactttagagagcttgtaaaggatttggcttctatctttaagacaagaattgagctgcgccaaatcggagtaagggatgaggcaaaaatgctcggaggaatcggtccttgcggaagaatgctttgctgttcaacgttccttggagattttgaacccgtttccattaaaatggccaaggatcagaacttgtctttaaatcctacgaagatttcgggtctttgcggacgattgatgtgctgtctaaaatatgagaacgatgagtatgagacggcaaaagaacagcttccggatataggagaaatgattacgacagcaaacggtcccgcgaaggtcgtcggactaaatattctggaacgggtgcttcaggtggaactgataaaccgtgaaaaagtgatagaatatacttgggaagagctcttggaagagggcgtcgtatccgcacaaaccacagattaacgaggtgtggaaccttggataaaaaagagttatttgatacagtcattaacttagaagaacaaattggctcactgtaccggcagctggggatttgaagcagcatatcggtgagatgattgaggaaaatcatcatttacagcttgaaaacaagcatttgcgcaaacggctggacgatacgacgcagcagattgaaaagttcaaagctgataaaaaagaatcaaaaacacagaagacagagcaaactgatataggggaaggatatgataatctggcacgtctgtatcaagaaggatttcatatctgcaatgtccactatggaagtgttcgaaaagaggattgtcttttctgtctgtcattcttaaataaaaaatagggaaaaggcttccgcataagacgggagcctttttcaaaggtactgaaaggataagaagatggtttcattacatgatgatgaaagattagattatttgctggcagaggacatgaaaatcatacaaagcccaacagtgtttgctttttcgttggacgctgtgcttctgtccaaatttgcgtacgttccgattcaaaaagggaaaatcgttgatttatgcaccggcaatggtattgtgccgctgctgctcagtacaagatcaaaagcagacattctgggagtcgaaattcaagaaaggctgcatgatatggctgttcgcagcgtggagtataataagctggacgatcagatccagatcatacatgatgacctgaaaaacatgccggagaaacttggacataatcgatatgatgttgtcacctgcaatccgccgtattttaaaacgccgaaacaaactgaacaaaacatgaacgagcatctccgaatcgcaagacatgaaatccactgcacgctggaggatgtcatttcagtcagcagcaaactgctcaagcaagggggaaaagcagctcttgttcaccggccgggaaggcttctggagatttttgaactgatgaaggcttatcaaatcgagccgaaacgtgtacaatttgtctatccgaagcaagggaaagaagccaataccattctggttgaaggtatcaaaggcgggcgtccagatttgaaaattcttcctcccttattcgtttatgatgaacaaaatgaatatacaaaagaaatcaggaccattttatatggagacaaataaccatttcttctacgtcgtgaaatgtaaggacaatagctggtatgccggatataccaacgatctgcataaacgagtgaaaacgcacaatgatggaaagggcgcaaagtacacaaaagtaagacgtccggttgaattaatttttgccgagagcttttcaacaaagcgggaagctatgcaggcggaatattatttcaaaaaactaactcggaagaaaaaagagctttatatagaagaaaagcggaacagcaaggaggctgtatatgttaaggcgccaaatgagctttaatggaaagtcggacatggggattctttacttggtcccaaccccaatcggaaatctagaggatatgacattccgggcgatcgacacgctgaaatcagtggatgcgattgctgcggaagatacgaggcaaacgaaaaagctttgtcatgtatatgaaattgaaacaccgctcgtcagctatcacgaacacaataaagaaagcagtgggcacaaaattattgaatggctgaagtcgggaaaaaacattgctcttgtcagtgatgccggtctgccgacgatttctgatcccggagcggaaattgtaaaggattttacggatataggcggttatgttgttccgttgccgggagcaaatgccgcattaacagctcttattgcttcaggtattgtaccgcagccttttttcttttacggttttctcaacagacagaaaaaagaaaagaagaaggagcttgaagcccttaaaaaacggcgggaaacgatcattttttatgaagcgcctcacagattgaaggaaaccttgtcagcgatggcagagatattaggagatcgggaaattgctgtaacgcgtgaactcactaagaaatatgaagagtttatccgaggaaccatatctgaggtcattggatgggcaaacgaagatcagatacgcggcgagttttgtcttgtcgtagaaggaagtaataatgaagaggtagatgaggaagaacaatggtgggaaaccctcactgcgaaagaacatgtcgagcattacatctcgaaaggcgctacgtctaaagaagccattaaaaaagcagcagtcgatcgcaatgtaccaaagcgtgaagtgtacgatgcttaccatattaagcaataaaaaaaacgttcttgtgtcataacaagaacgttttttgtacaagaaatgattatttaaggttttgaagctggttttggatttcgctgatgatttgctcagcgccttctttactaagaaccaatttaccgcctgcaagtttaaggttatcatcagaaacttcaccagttacttggcaagtcatgtttggtttatattttttaaggatgattttttcatcatcaacatagatttcaagagcatctttttctgcgattccaagagtacgacgcagttcgataggaataactacacgtcctaattcatcaactttacgtacaataccagtagatttcataaacattctcctcccaagagatacttatttgtttaaattatatttttcttcgtcattattcgacaaaatccttaccttcatagcataacaaggtttccaataatcgtcaatcattttgtttactattgattgtaagaattagttcttatagtcagtaatgtcttagaaactaccgaaataacagcattttataaatatttaataaagctattatcctactaaaaatccttttaaatcaagactttcgaaccaaagttttttatttcatttgattatatacgacaaaattcgacacgaacagactttttttattttcattaaagatttttaattttaattattctttttcagggtgtatgtatatattcttgatcttaaaggctaagatggtatcatagataaaggataaatataaataatattcatatatgatttgcacttatcgccgctctcgtcctttgggcgggagctttttgacattctgattaggaggtttcaagatgccgcaagaaaacaatacattttacattacaacaccgatttattatccgagcggaaaattacatatcggccatgcatatacgacagtcgcaggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacgacagaaaaacggcataaagttgtcattgaaaaggtgtttcaaaagcttcttgataacggggacatctatcttgatgagtatgaaggctggtacagcatccctgatgaaacgttctacacggaaactcagctcgttgatattgagcggaatgaaaagggagaggtcatcggcggaaaaagccctgacagcggtcacccagttgaattgatcaaagaggaatcttatttcttccgcatggggaaatacgcggatcgtcttctgaaatactatgaagaaaacccgacattcattcagccagaatcacgcaaaaacgaaatgattaataactttatcaaacctggacttgaggatttggcagtatcacgtaccacttttgattggggcgtgaaggtgccggaaaatccaaagcatgttgtatatgtttggattgacgcactatttaactatttaacagcactcggttatgatacagaaaatgatgagctttatcaaaaatattggcctgccgatgttcatttagtcggtaaggagattgtacgattccatactatttattggccaattatgctgatggctctggatcttccgctgccaaagcaagtattcgcgcatggctggcttttgatgaaagacggaaaaatgtcgaaatcaaaaggaaacgttgtagatccggttacattaattgaacgctatggtttagacgagcttcgctattacctgcttcgtgaagtgccgttcgggtctgacggtgttttcacgccggaaggatttgttgagcgaatcaactatgatttagcgaatgatttaggaaatctattgaatcgtactgttgcgatgatcaataagtattttgacggacaaattggttcttacaaaggtgctgttacggaatttgaccaaacgctcacttcggttgctgaagaaacagtgaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcatctcgctgaatcattgcgtatttcagcggtactgcttcagccattcttaacaaaaacaccggaaaaaatgttcgagcagctgggcattaccgatgaatctctaaaagcttgggacagcattacaactttcggccagctgaaagatacaaaagtacaaaaaggcgagccattgttccctcgtttagaggcagaagaagaaattgcttacatcaaagggaaaatgcaaggttcggcaccagcgaaagaagaaacaaaagaagaagagccgcaagaggtcgatcgtttacctgaaattacgattgatcaatttatggatgtagagcttcgcgtagctgaggtcattgaggcagagccagtgaaaaaagcagaccgtttattgaagctgcagctcgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtgtctatcgatcagtcgttaccaaaaggcacaagaattaaataatgataaaacaaaaggtgtttcacgtgtaacaattcgtcgaacaccttttgtgtttcgacaagaaaggagtttttcacttatgttgtttgacacacacgcgcatttaaatgcagaacaatatgatactgatcttgaagaggttattgaacgggcaaaagctgaaaaagttgaacgaattgtcgtagttggttttgaccgtccgacgattacccgtgcgatggaaatgattgaggaatatgattttatttatgcagccattggctggcaccctgttgacgctattgacatgacagaggaagacttagcgtggattaaagagctttctgctcatgagaaagtggtagcgataggggaaatgggactggattatcattgggataaatcacctaaagatattcaaaaagaggtgtttagaaaacaaatcgccttagcgaaagagttcaatttgcctattatcattcataaccgtgatgcaacggaggatgtcgtgaccattttgaaagaggaaggcgcagaagctgtgggcggaatcatgcactgctttacaggaagtgcggaagtggcaagagaatgcatgaaaatgaatttttatttatcatttgggggaccggtgacatttaaaaatgcgaagaaaccgaaggaagtagtgaaggaaattcccaatgaccggctgctgattgaaacggactgcccgtttctcacaccgcaccctttccgcgggaaaagaaatgagccaagctatgtgaaatatgtggcagaacaaatcgccgaattaaaagaaatgacctttgaagagattgcgtcaatcacgactgaaaatgcgaaaagacttttccgtataaactgacaaaaaacgctagcgggttttgtaagagcttgtcccttacagcgtttttctataaaagttctacatgctttcttctcctcataggataggtttgtcgacaagtctttcttccgtttctcagtgtatttcaggataatgaagaagacactgagcttttgggagaaagagaagggagggttgacagccttttagatactctatataatctctccgaggagaaggaggcgtttttcatcacacaaaaaatgaaaaagctgttttccgtaaagcttagcaaaagcaaagtcattctggttgctgcttgtttgcttttggcaggaagcgggactgcgtacgcggctcatgagctgacgaaacaatcagtctcagtttctatcaatggcaaaaagaaacatatacgcacacatgcaaatacagtcggtgatcttttggagacgcttgatataaagacaagagacgaagacaagatcacacctgctaaacagacaaagataacagcagacatggacgttgtgtatgaggctgcaaaacctgtgaagcttacaataaacggggaagaaaagacattatggtcaacagcaaaaacggtcggtgcattactggacgaacaagatgttgatgtgaaagaacaagatcaaattgatcccgcaatagatacagatatttcgaaagacatgaagattaacatagagcccgcatttcaggttactgtgaatgatgcagggaaacaaaagaagatctggacgacttcgactacggtcgctgactttttaaaacagcaaaagatgaacataaaagacgaagataaaatcaagcctgcgttagatgcaaagctgacgaaaggaaaggctgatattacaattactcgtatcgaaaaggtcaccgatgtagttgaagagaagattgcgttcgatgtgaaaaagcaagaagacgcttctcttgaaaaagggaaagaaaaggtcgtccaaaaaggaaaagaaggcaagctaaaaaaacatttcgaagtcgttaaagaaaacggtaaagaagtgtccagagagcttgtaaaagaagaaacagctgaacaaagcaaagataaagtgattgctgtcggcacaaagcaaagcagtccaaaagttgaaacggtcagtgcttcaggtgattcaaaaacagttgtgtcccgcagcaatgaatcaacaggcaaagtcatgactgtatcatctacggcttatacggcaagctgcagcggttgttcaggacatacagcgacaggcgtcaatttaaaaaataatccgaatgccaaagtcatcgctgtggatccaaatgtcattccgctaggctccaaagtccacgtggaaggctatggatatgctattgctgcagataccggttcagcgattaaagggaacaagatagacgtctttttcccagagaaatcatcggcgtaccgatggggaaataaaacagtcaaaattaaaatcttaaattagtatatacttatgtattcagagggttttgcgccctctgtttttttcgttataatagacaaagtgcattttctgcttattagacgctcgacataagaaaaagtttcatgaatatacaaaagtttttattttgtcttggaggaaataatgaaaattaaagagatcattgtggtcgaggggcgtgatgatacggcccgcatcaaattggctgttgatgcagacacaattgaaacaaatggttcagccatcgatgatcatgtgattgaccaaatccgtttggcccagaagaccagaggcgtcattgttttaacggatccggactttccgggagagaagattcgcaaaaccatctcagaggctgtgcccggctgtaagcatgcatttttgccaaaacatcttgccaaacctaaaaacaagcggggaattggtgtggagcatgcatcggttgaaagcattagggcatgtttagaaaatgtgcatgaggagatggaagcgcagccgagtgacatttcagctgaggatttgattcatgccggactaataggcggacctgcggccaaacgccgccgggaacgactgggtgatctgttgaaaatcggctatacaaatggcaaacagcttcaaaaacggctgcaaatgtttcaaattaaaaaaagtgattttatgagtgcactcgataccgttatgcgggaggaacagaatgaataaagatattgcgacaccgattagaacgaaagagatactgaagaaatacggtttttcttttaaaaagagcttaggacagaatttcttaattgatacgaacattttaaacagaattgttgatcacgcggaagtgactgagaaaacaggtgtcattgaaatcggcccgggaatcggggctttaaccgaacagcttgccaagcgggcgaaaaaggtcgtggcatttgagattgatcagcgattattgccgattctgaaggatacactgtcaccttacgacaatgtcactgttattcatcatgatgtgttaaaggctgatgtcaaatcggtcattgaagaacaatttcaagattgtgatgaggtcatggtagttgccaaccttccttattacgtaacaacaccgattatcatgaaactgcttgaagaacatcttccgctgaaagggattgtggttatgctgcaaaaagaagtggctgagcgcatggcggctgatccttcatctaaggaatacggctcgctttcaatcgcggtgcagttttatacagaagccaaaacggtgatgatcgttccgaaaaccgtatttgttcctcagcctaatgtcgattccgcagtcatccgtctgattctccgagacggcccggcagtggacgtggaaaacgaatcttttttctttcagctcatcaaggcaagctttgcacagcgccgtaaaacgctgctcaataacttagttaacaatctgcctgaaggaaaggcgcaaaaatcaacgattgagcaagtgctcaaagaaacaaatattgacggtaagcgccgaggtgaatccctgtctattgaggagttcgcagcgctgtctaacggattgtataaagcccttttctaaaagggctttttgttttgcgcaccacatggactgccgctacataggctagagaaggacctttcattcaatgataagaaaaacttggactcagcgaaaaaaggcgctttctcaaggctctttctttcatgatgaggcttagtctatgtgtggagtgaggaacgtgcaatttcaaataggggatatggtagccagaaaatcctatcagatggatgttttgtttcgaattataggaatagagcaaacaagcaaaggaaattcaattgccattttgcatggagatgaagtcaggctgattgctgattcggatttttctgatctggtggcagtgaaaaaggatgagcagatgatgcggaaaaagaaagatgagagcagaatgaatgagtcgctcgaattactccgccaagattataagctgctcagagaaaagcaggagtactatgcgacaagccaatatcagcatcaggagcattatttccatatgccgggcaaagtgcttcatctggatggtgacgaagcatatctgaaaaaatgcctgaatgtctataaaaaaattggagtgccggtctatggcatccattgccatgaaaagaaaatgtctgcttctattgaagaattgctcgacaaatatcgacctgatatcctggtgatcacagggcatgatgcgtattcgaagcaaaagggcggcattgatgatttgaatgcgtacagacattctaagcactttgttgaaactgttcaaacagcccgaaaaaagatccctcacttagatcagcttgttatttttgcgggggcctgccaatcccattttgaatcactcatcagagcgggtgcgaattttgcaagttcaccgtcaagagtcaatattcatgcgcttgatccggtatatatcgtcgcgaagatcagctttacgccgtttatggaacggattaatgtatgggaagtgctccgtaatacgctgacaagagagaaagggcttggaggtattgaaacaagaggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagtgaggtggatgcaatggcgaagacgttgtccgatattaaaagatcgcttgatgggaatttaggtaaaaggctgacgttaaaagcaaacggtggccgccgaaaaacgattgagcgttcgggcattttagctgagacgtacccttctgtttttgtgatacaactagatcaagacgagaactcgtttgaaagagtttcatacagttatgctgatattttgactgagactgttgagctgacatttaatgatgacgccgcaagctcagtggcattttaacgggcagtgaaccttttgtttactgctttttgttttgcccttttttggtttccaataattttaacgaaagttccatctgatttaacaaaagataaaacagtcacatattatcgtgacgtgcacgaatggctatcacttctaaaaaaggggttgtttcgtttgggcagacgtcgtggagttatgtcagatgagtttaaatatgagcttgctaaagaccttggtttttatgacacagtaaaaaatggcggctggggcgaaattcgggctcgcgatgccggtaacatggtaaagcgcgctatagaaatcgccgaacagcaaatggctcagaatcagaataaccgataaggatgtgacccggggacgtgctgttccctggtttttttattttggatataaatacataatgggctgaatatggatatgttcatcctgtacttcaaatgtgatacaatgttcatacttatgtttagatggagaagtaggtgaaagctatgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaggtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactgtggaatttaaatctgtccgcggaaacgcttgctgagcttggagcggaaattggctctgacgtttcattttgtgtctatggcggaactgcattagcaacagggcgcggcgagaaaattaaacatatcagcacgcctccgcactgctgggtcattttagcgaagccgacaatcggtgtttcaactgctgaagtgtacagagcgctgaaactggatggtatagagcatcccgatgtacaaggcatgatcgaggcgatagaagagaagagttttcagaagatgtgcagccgtttaggcaatgtgcttgaatctgttacactcgacatgcatcctgaagttgcgatgattaaaaaccagatgaaacgctttggtgcagatgccgtgttaatgagcgggagcggcccgacagtatttggactggttcagtatgagtcgaaggtgcagagaatttataacgggttaagaggcttctgcgatcaagtttatgcggtgagaatgatcggcgaacagaacgctcttgattaaatccgtatgttaagttatattgatcttaaaatattcggattttgggggtaagttcatgaagtttcgtcgcagcggcagattggtggacttaacaaattatttgttaacccatccgcacgagttaataccgctaacctttttctctgagcggtatgaatctgcaaaatcatcgatcagtgaagatttaacaattattaaacaaacctttgaacagcaggggattggtactttgcttactgttcccggagctgccggaggcgttaaatatattccgaaaatgaagcaggctgaagctgaagagtttgtgcagacacttggacagtcgctggcaaatcctgagcgtatccttccgggcggttatgtatatttaacggatatcttaggaaagccatctgtactctccaaggtagggaagctgtttgcttccgtgtttgcagaacgcgaaattgatgttgtcatgaccgttgccacgaaaggcatccctcttgcgtatgcagctgcaagctatttgaatgtgcctgttgtgatcgttcgtaaagacaataaggtaacagagggctccacagtcagcattaattacgtttcaggctcctcaaaccgcattcaaacaatgtcacttgcgaaaagaagcatgaaaacgggttcaaacgtactcattattgatgactttatgaaagcaggcggcaccattaatggtatgattaacctgttggatgagtttaacgcaaatgtggcgggaatcggcgtcttagttgaagccgaaggagtagatgaacgtcttgttgacgaatatatgtcacttcttactctttcaaccatcaacatgaaagagaagtccattgaaattcagaatggcaattttctgcgtttttttaaagacaatcttttaaagaatggagagacagaatcatgacaaaagcagtccacacaaaacatgccccagcggcaatcgggccttattcacaagggattatcgtcaacaatatgttttacagctcaggtcaaatccctttgactccttcaggcgaaatggtgaacggcgatattaaggagcagactcatcaagtattcagcaatttaaaggcggttctggaagaagcgggtgcttcttttgaaacagttgtaaaagcaactgtatttatcgcggatatggaacagtttgcggaagtaaacgaagtgtacggacaatactttgacactcacaaaccggcgagatcttgtgttgaagtcgcgagactcccgaaggatgcgttagtcgagattgaagttattgcactggtgaaataataagaaaagtgattctgggagagcccgggatcacttttttatttaccttatgcccgaaatgaaagctttatgacctaattgtgtaactatatcctattttttcaaaaaatattttaaaaacgagcaggatttcagaaaaaatcgtggaattgatacactaatgcttttatatagggaaaaggtggtgaactactgtggaagttactgacgtaagattacgccgcgtgaataccgatggtcgcatgagagcgattgcatccatcacgctggatcacgaatttgttgtacatgatattcgtgtgattgatggaaacaatggtcttttcgttgcgatgccgagtaaacgcacccctgatggagagttccgcgatattgctcatcctattaattcaagcacgcgaggaaagattcaagatgccgtgttaaatgagtatcatcgtctgggtgacactgaagcattagaattcgaagaagctggagcttcttaaaaaataaccaaaaagcaaggactgctgaaagggctgacataagccttttgccggcggtccttttttaattctgatttttcaaacttagttgcactcaatagaaaattcttgcacttcatgaagtctccttgaaatcagaagatatttaggatatatttttctatggataaaagggatattggaggccaataaatggataagcggtttgcagttgttttagcggctggacaaggaacgagaatgaaatcgaagctttataaagtccttcatccagtttgcggtaagcctatggtagagcacgtcgtggacgaagccttaaaattatctttatcaaagcttgtcacgattgtcggacatggtgcggaagaagtgaaaaagcagcttggtgataaaagcgagtacgcgcttcaagcagaacagcttggcactgctcatgctgtaaaacaggcacagccatttcttgctgacgaaaaaggcgtcacaattgtcatttgcggagatacgccgcttttgacagcagagacgatggaacagatgctgaaagaacatatacaaagagaagcgaaagctacgattttaactgcggttgcagaagatccaactggatacggccgcattattcgcagcgaaaacggagcggttcaaaaaatcgttgagcataaggacgcctctgaagaagaacgtcttgtaactgagatcaacaccggtacgtattgttttgacaatgaagcgctatttcgggctattgatcaggtgtctaatgataatgcccaaggcgagtattatttgccggatgtcatagagattcttaaaaatgaaggcgaaactgttgccgcttaccagactggtaatttccaagaaacgctcggagttaatgatagagttgctctttctcaggcagaacaatttatgaaagagcgcattaataaacggcatatgcaaaatggcgtgacgttgatcgacccgatgaatacgtatatttctcctgacgctgttatcggaagcgacactgtgatttaccctggaactgtgattaaaggtgaggtgcaaatcggagaagatacgattattggccctcatacggagattatgaatagtgccattggcagccgtacggttattaaacaatcggtagtcaatcacagtaaagtggggaatgatgtaaacataggaccttttgctcacatcagacctgattctgtcatcgggaatgaagtgaagatcgggaattttgtagaaattaaaaagactcaattcggagaccgaagcaaggcatctcatctaagctatgtcggcgatgctgaggtaggcactgatgtaaacctgggctgcggttcaattactgtcaattatgatggaaagaataagtatttgacaaaaattgaagatggcgcttttatcggctgcaattccaacttggttgcccctgtcacagtcggagaaggcgcttatgtggcggcaggttcaactgttacggaagatgtacctggaaaagcacttgctattgccagagcgagacaagtaaataaagacgattatgtgaaaaatattcataaaaaataatcctaaattcggaggtttatccatgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcaccagaccatggcggtgtgacacgtgcccgcaaactggctgaccgactaaaagcgccaattgcgattatcgataaacgccgtccgcgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggtagaacggattaataattcaacaattaaagagcttgttgtgacaaacagcatcaagcttcctgaagaaaagaaaattgaacgctttaagcagctttcagtcggaccgcttctggccgaagcgattattcgcgttcatgagcagcaatcagtcagctatctgttcagctaaaccatttttcgaggtttaaatccttatcgttatgggtattgtttgtaataggacaactaaaacgacaataggatggtgctgaatatggcaactttaacggcaaaagaaagaacggactttactcgttcgtctcttcggaatatccgtacttcaggacatgttccaggtatcatatatgggaaggatacgggtaacaaacctgtgtcattagacagtgtggagctcatcaaaacgctgagggacgaaggcaaaaatgcagtcattacgcttgaggtcagcggagaaaaacactcagtcatggtaacagacctgcagacggacccgttgaaaaatgaaatcactcatgctgattttcaagtagttaatatgagtgaggacattgaagtggaagttccgattcatctgaccggagaagccattggagtgaaaaacggaggcgtactgcagcagccgttatatgcacttactgtaaaggccaagccaaaagccattccgcaaacgattgaggctgatatttcaagcctcgatgtaaatgaagtactgacgattgcggatttgcctgctggcggtgactactcctttaatcatgaatcagatgaggttgtggcttcaatccttcctccgcagcagcaggaagcagctgaggtcgatgaagaggaatctgccgatgctcagccagaaggtgaaaacgaacaataatagcttaaggcgtaaccctcccgcggttacgtcttttgtgctagaatgagaagaattatagcccgattatgaagacgggagttatgtgactaagggaggattcgccatgcttgtgattgccggtctcggaaacccggggaagaactatgaaaatacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacatccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataaaatgtaacaacaaagtccatactacaccaaaatgactttttcatcaggaggtcccttgtatggctttgcattattattgtcgtcattgcggagtgaaagtaggcagtctcgaatcttcaatggtatcgacagactcacttggatttcagcacttaacaaatgaggaaagaaacgatatgatttcttataaagaaaatggagatgtccatgttttgacgatatgtgaagattgccaagaggcgcttgaccgaaatccgcattaccacgaatatcacacatttattcaataaaaagctttggtgtagacactagaccaaagcgtttttctgttctcgcaggaaacagagaggaggggccatatggacaacattcaaacctttataaaagaaagcgatgactttaaatccatcatcaacggtttacacgagggcctgaaggaacagctgctcgcgggtctgtcgggttccgcgcgttctgtttttacttctgctctggctaatgaaacgaataagcctatctttctcatcacccataacttatatcaagcccagaaagtaacagatgatctgacttcacttctagaggatcggtctgtccttttgtaccccgtcaatgaactcatttcatcagaaatcgcagttgcaagccctgaattgcgggcgcagcgattagatgtcattaatagactaacgaatggagaagcgccaattgtcgttgctccggtagcggcaatcagaagaatgctgccgcctgttgaggtgtggaaaagcagccagatgctcattcaagtaggccatgatatcgaacctgaccagcttgcctcacggctgatagaggtagggtatgagcggtctgatatggtttctgcgcccggggaattcagtattcgcgggggaatcattgacatttatccgttgacttcagagaatccggtgagaattgaactttttgacaccgaggtggattcaatccgcagctttaattcagatgatcagcggtcaattgagacccttacctcgatcaatatcggtcccgcgaaggaattaattatcagaccggaagaaaaagcgcgggcgatggagaaaatcgatagtggtcttgccgcgagcttgaaaaaattaaaggctgacaaacaaaaagaaatacttcatgcgaatatttctcacgataaagaacgcttgtctgaaggccagacagatcaggagctcgtgaagtatctctcatatttctatgaaaagcctgctagtttactagattatacacctgataatacacttctgattttggatgaagtcagtcggattcatgagatggaagagcagcttcaaaaagaagaagcggagtttataacaaatcttcttgaggaagggaagattttgcatgacattcgtttgtcattcagcttccaaaaaatagtggctgagcaaaaacggcctctgctgtactactctttatttttgcggcatgtacaccatacgagcccgcagaatatcgtcaatgtgtcaggccggcaaatgcagagtttccatggccaaatgaacgtgcttgcgggcgaaatggagcgttttaaaaaatcaaatttcactgttgtgttcttaggagcaaacaaggaacgtacacagaaattgtcatctgttttggctgattatgatatcgaggccgccgtgacagacagcaaaaaagcgcttgttcagggacaggtctatatcatggaaggcgagctccaatcgggatttgagctgccgttaatgaagcttgccgttatcacggaagaagaactgttcaaaaaccgtgtaaagaagaagccgcgaaaacagaagcttaccaatgcagagcgcatcaaaagctattctgagcttcaaattggagattatgtcgttcatattaatcacgggatcggaaagtacctggggattgaaactcttgaaatcaacggcattcataaagactatttaaatatacattatcagggcagtgacaagctttacgtccctgtagaacaaattgatcaggtccaaaaatatgtcggctccgaaggaaaagagccaaagctgtataaattaggcggaagtgaatggaagcgggtcaagaaaaaagtagagacatccgttcaagatattgctgacgacttaattaagctgtatgccgaaagagaagcgagcaagggctatgcgttttctcctgaccatgagatgcagcgtgaattcgaatcggctttcccttatcaagagactgatgatcagctccgttcgattcacgaaatcaaaaaagacatggaaagagaacgtccgatggaccgcttgctatgcggagatgttggctacggtaaaacagaggttgccatacgtgcagcgtttaaggcgatcggtgacggaaagcaggtagctctgctcgttccgacaacaattttggcgcagcagcactatgaaaccataaaagagcgcttccaggactatccgattaatatcggacttctcagcaggttcagaacgagaaaagaagcaaacgaaacaattaaagggctgaaaaacggaacagttgatatagtcatcgggacgcatcggctgctatcaaaggatgtcgtgtataaagatttagggctcctcatcattgatgaagagcagcgtttcggtgtaacccataaagaaaagatcaagcaaataaaagccaatgttgatgtattaacgttaacagcaacgccgattccgcgtacgctgcatatgtctatgcttggcgtaagggacctttcagtcatcgagactccgccggaaaatcgcttccctgtacagacgtatgttgtggaatataacggcgctcttgtcagagaggcgattgaacgagagcttgcacgcggaggccaggtctatttcttgtacaaccgggtagaggacattgagcggaaagcggatgaaatttcaatgctagtccctgacgcgaaggtagcatatgcgcatgggaaaatgacagaaaatgaattagaaaccgttatgctaagtttccttgaaggagaatcagacgttctggtcagcacaaccattatcgaaactggcgtggacatcccgaacgtcaatacgctgatcgtatttgacgctgacaagatggggctttctcagctttaccagctgcgggggcgtgtcggccggtctaaccgtgtggcgtatgcgtacttcacgtatcgccgggataaagtgctgacagaagtggctgaaaaaaggctgcaggctattaaagaattcacagagctaggttccggttttaaaatcgcaatgcgtgacttaacgattcgcggagctgggaatcttcttggtgcccagcagcatggcttcatcgattcggtcggatttgacctctattcacaaatgctgaaggaggccattgaggagcgtaaaggagacacagcgaagacagagcagtttgaaacagaaattgatgtcgagcttgatgcgtatattccggaaacttatattcaagacggcaaacagaaaattgatatgtataaacgcttcaggtctgtggcgacaatcgaagagaagaatgagcttcaagatgaaatgatcgaccgctttggaaactatccaaaagaagtcgaatacttgtttactgttgcagaaatgaaagtctacgcgagacaggaacgtgtcgagctgattaagcaggataaagatgctgtcagattgacgatttctgaagaagcaagtgctgaaattgacgggcagaagctgtttgagcttggcaatcaatatggcagacaaatcggactgggaatggaagggaaaaaactcaaaatctccatacagacgaaaggccgtagtgctgatgaatggctcgacaccgtgctgggcatgctgaagggcttaaaagatgtgaaaaagcaaaccatttcatcaacgtaaattttgttactctctggtgtatattacatttgatgtgacggatactaatttcaagcgaggcggaaggtacataaagtaactgctttaggtctttcccacatgtatataccatcaaatgaaagagaggcaccagagatgaaagcaaccggtatcgtacgtcgtattgatgacttaggtcgggtcgtgattcctaaagaaattcgaagaactctgagaatcagggaaggcgatccgcttgagatttttgtagatcgtgacggagaagtgattttgaaaaagtattctccgatcagtgagcttggagactttgcaaaggagtatgcagacgcgctttacgacagcctcggccattcagtgctgatttgtgatcgtgatgtatatattgccgtgtccggcagctccaaaaaagattacttaaacaagtcaatcagcgaaatgctggaaagaacaatggatcagcgcagctccgtgcttgagagtgatgcgaaatcggtacagcttgtgaatggaattgatgaggacatgaattcttatactgtcggcccaattgtggcgaacggtgatccgataggtgctgtggtgattttttcaaaagatcagacaatgggcgaagtagagcataaagccgttgaaacagcagctggatttttggctcgtcaaatggaacagtaggtcttattcctttcttcgaaaataggtatgtaaagaacagctctccttgggacgctgttctttttcatgcgtgccgaaaaaggaatccaagggttgggatgtggtataataacctcgtttttatttgtgccgcggtaatacgtgaaccgtattgcccctgacgttgggaaggagcttttggatggacgattcaataggcgttaaacggcattggatttggcagggggcttttgttttaattctggcaggcgtcatcacaaaaattttaagcgccgtttacagagtcccgtttcaaaacattgtcggcgatgttggattttatatatatcagcaggtatacccctttcttggtattgcggtcatgctgtccacatcaggatttccagtcattatttcaaagctgatgaatgattatagtgaaaaaaatcatcacactatattaaaaatatcagtgttatttttatctttaatcggtattttattatttctttgtttatatctgggtgctgttcctattgcgctctttatgggggattcgcatttagccgtgttaattcaagtgaccgcgtacgcgtttctgctgttcccgtttgttgcgttgcttagaggcagttttcaagggcgtcacgaaatgctcccttcagccttatcacagatgacagagcagtttctgcgtgttgcggtgctattgggtttatcattttggctcgtgaaaaagggagcctcgctttatactgcgggagcggcagccgcttcaggctctcttgccggaagtttggttgcgttgatgatactggggtttttttggttcaaaacgaaaagagacaaccaaacggataggcaaaacgaaaatgtcatcacaacaaaagaattgacgaaaaaactgcttttatattcgattacaatttgtgtaagcagtttgctgcttttgtttatccagcttgttgatgctttgaatttatatgctttgctttcgggtggtgaggcaagcgaagaagcgaaacgcctaaaggggatctatgatcggggacaaccgttgctgcagctcggttcaattttcgcggtgagcattgcgacgtcactcgttccgtatatttctatggccgtaaaaaacaatgagctgaagatcatgaaagaaaaaatcacgtcatctttgaaactatgccttgtgctcggtacaggcgcatcggctgggttgatttgcattcttaagccggttaatatcatgctgtttcaaaatggagaagggacaggtgcgttacaagtatttagctgctccattttgtttgcatccttgggggtaacggcagcggcagtcttacagggagcggggtacacagtttttcctgcgatagcggtgggagcgggtgttgcagtgaaatgggtgctaaacacacttttggttccgcgctatgggattgaaggcgcatcgcttgcgacagcggcttcctttgcggctgtcgcaggcctcaacttgtatcagcttcggcaaaaggaatggctcgataagcttagaggcgttttgattcccattattggatctgctcttttgatgtcagctgtcttgcttgcgtatatgcgtttctggacttttttgtttcctgctacaggaagaggagcggctgtgattgagagtctttctgctgttgctattggtggcgcggtgtttatttattgtatgatgagattgggaatatttacagatgaagagctgaacagtgtgccattcggcagcaagttaagcaaattcatgagaaggagagaacaaaatggcgggtaaaattacagtcgtgggacttggtgccggagacatggaccagttgacaattggtatacacaagctgctgacgaaggcagatacgctgtatgtcagaaccaaggatcatcctttaattgaggagcttgaaaaagaaacgaagaacatccgtttctttgatgatatatatgagaaacatgatcagttcgaggcggtatatgaagaaattgctgatatcctctttgaagcggcgcggcgtgaggacgtggtttatgctgtgccggggcacccttttgtcgcagaaaaaacagttcagctgctgacggagcggcaggaaaaggaaaacgttcaagtgaaagccgcgggtggacaaagtttccttgatgccacattcaatgccttgcaaattgacccgattgaaggttttcaatttgtggatgccggcacattgtctgcggatgagcttgagctcagacatcatctgatcatatgtcaggtttacgaccaaatgacggcttctgaagtcaagctgacattgatggagaagctgcctgatgattatgaggtcgtcattgtgactgcagcaggcagccgtggcgaggagatcaagacagtgccattatttgagctggaccgcaatgtcgccttgaacaacttaacaagtgtgtatattccgccgattaaagaagagaagctgctttatcacgaattctccacgttccgaagcatcatcagagagcttcgcggacctaatggatgtccgtgggataaaaagcagacgcatcagtcattaaaacagtacatgattgaagaatgttatgagcttctcgaagctattgacgaagaagacacagaccatatgatcgaagagcttggcgacgttttgcttcaggtcttgcttcacgcgcaaattggtgaagatgaaggttatttcacaattgatgatgtcataaaaggaatcagtgaaaaaatggtccgaagacatccccatgtgtttaaagatgttaaggttcaggatgaaaacgatgttttggccaattgggaagatataaaaaaggccgaaaaaaatacatctgaatcatcgttactagacagcgtaccgaaaacccttccagctctttcgaaagctgctaaattgcagaaaaaagcagcgaaggtcggttttgactgggaagacgtcagcgatatttgggaaaaggtaagtgaggaaatgaaggaattttcttctgaggtttctgaagctcctcacgaccacaatcttaaagctgagtttggcgacattttgttcgcgctggtgaatgtagcccgcttctacaaaatagagccagaggaagcgctgaccatgactaatgacaaattccggagacgcttctcgtacattgaggaaacagcgaaggaaaagggagtcgagttggctgatatgtcccttgaggacatggacaaactgtggaatgaagcaaaagaaactgagaggagatcatagatatgagattagataaatttttgaaagtatcacggctgatcaaacggcgtacactagcgaaggaagtagctgaccaaggacgaatctctattaacggaaaccaagctaaagcaagctctgacgtaaaaccgggagatgaactaacggtccgcttcggccaaaagcttgtaacggttcaagttaatgaattgaaagacacgacgaaaaaagaagaagctgcaaacatgtacacgattctaaaagaagaaaaactcggcgaataggcttgttctaaaaaaatcccctacctcatacaatgcagtaataatgctaaaagtatcgaggatatgggggctgaatagatgaattcatattatgatcaaaaaggttcttcgtctgttccggaacaacatgatgtgacaatgaaaggccggaagcatttagatatttctggggttaagcatgtggagagttttgataacgaagaattcctgctggaaacggtgatgggaatgctctccgtcagaggccaaaacctgcagatgaaaaatcttgatgtggaaaaagggattgtttcgattaaaggcagggtatttgatttagtgtacttagacgaacaacaaggggataaagctaaagggttttttagcaagttgtttaaatgacgctgacgacacaattctatacaatgctggcgatgtccggtatgggtctctggcttggtgcttcgcttgatacataccggctctttgtcattcgtgccaaaacagccagatggctattatttattcatgatattcttttctggattgtgcaagggctgcttttcttttatgtcttgcttcatgtaaatgagggagaattcaggatttacatctttttagcggttctgctgggcgttgcgacgtatcagagcctttgcaaacgaatctatataaaaatactgaaattcttcatttaccttgttgtttctgtttatcaattcttcaaaaaactcattcagcacgtgttatttcgtcctattgtgtggacatgcggagcgatcatctggctggcggcatttttattcaagaaaacatacagcctgataggttttctcctgctgtgtctatataaaatagtcatggttctgtgttttccgatccgttttatcgcgaaacaatgtttgaaacttcttcctgtgaaaatgcgtctaacttttagacgttattttgaaaaaggtgcaggatttctcaaaaagaagaagaaactattgataaccataagaacgaccattacacggtttttgaagaaatgaaaggaggaccgtctggtttgaatttttccagggaacgaacgataactgaaatacaaaacgactataaagaacaagtagaacggcaaaatcagctgaagaaacgaagacgcaaagggctgtacagacggttaactgtattcggcgccctagtattcctgacggcaattgtgctggcaagctctgtatggtcccaaacatcttcccttagtgcaaaagaagaaaagaaagaacagcttgaaaaagaactcaaaagtttaaagacaaaacaaacggatttaaaagaagaaatatccaaattgaaggatgaggattacgtcacagagcttgccagaagggacttattcatgtctggagacggagaaattatcttcaatgtggagaagaagagcaagtagccttgttgacacttaaatttttatttaggtataattaagcaaacgatctttttataagcctaaggaggagcactttttttatgtcgattgaagttggcagcaagttgcaagggaaaattacaggtattacaaattttggagcatttgttgaattgcctggaggctcaaccggtctcgttcacattagtgaggtagctgataattatgtcaaagacattaacgaccacttaaaagtcggcgaccaagttgaagtgaaagtcatcaacgttgaaaaagacgggaaaattggtttatctattaaaaaagctaaagaccgtccgcaagccagacctagaaatgatttccgtccgaaagaatcttttgaacagaaaatgaataagtttttaaaagacagcgaagatcgcttgtcatctttaaaacgcaatacggaatcaaaacgtggagggcgcggagcaagaagaggataacttgctgctttctataaaataaatgaagcatccgttcatcccgacggatgcttttttattatcctcatcctctttaagagtcagaaaattacaacattaaagtttctgttgacgaaagagacaaacctttgtattatataacttgtgcttagaagcacaaaacaatatggcggtgtagctcagctggctagagcgtacggttcatacccgtgaggtcgggggttcgatcccctccgccgctaccatatttgtttggcccgttggtcaagcggttaagacaccgccctttcacggcggtaacacgggttcgaatcccgtacgggtcatcctaaaaaatcggtttctcttgcagaagccgatttttttcatttttagacaacattccggaaattcttttcataaacgaatatcaaggcagaaaccgtcgaagatttctttggtattgttaccttcttttgacaaaatcctatctgtgctttcgctataatgacaggcaacgaatataacaggtgggagatgagaggaatggaaaaagcagaaagaagagtgaacgggccaatggcgggacaagctctggaaaaactccaatcgttttttaacaggggcacgaagctggtgactcatcatttgcattcactgtttttctataaaggattcatttatgttgtcatcggatttttgcttggacgggctttcatattatccgaggtgcttcctttcgcacttcctttctttggagcgatgcttcttatcagaagagacaaagcgttttatgcggttttggctgtgcttgcaggtgcgctgaccatatctccaaagcactcattgctcatactggcggcattgctggcattcttcgtattttctaaagtggctgccttcattaccgacgatcgtgttaaagcgctcccgattgtcgtgttcttctcgatggctgcagcaagagccgggtttgtttatgcccaaaatggcgtatttacaacctatgattatgtaatggctatcgttgaggctggactatcgtttatcttaacactgattttccttcagagccttccgatttttactgtgaaaaaagtgaaacaatcattaaaaatagaggaaatcatttgctttatgattcttattgcctctgttttaacggggctggccggcttgtcctaccaagggatgcaggcagaacatatattggctcgttatgttgtattgagtttttcctttattggcggagcaagcatcggctgtacggttggtgttgtgaccggcctgattcttggcttggcgaatatcggaaacctatatcaaatgagtctgcttgctttttccggtttattgggcggtttgctgaaggaagggaaaaaagcgggtgcagcaattggtttgatcgttggatcacttcttatatctttatatggtgaaggctctgccggtctgatgacaacgctctatgagtcattaatcgcagtcggcttgtttttgctcacacctcaatctattacaaggaaagtggcgagatatattccgggaactgtcgagcatcttcaagagcaacagcaatacgctagaaaaatccgtgatgtcactgctcagaaggtagaccagttctccaatgtatttcacgcgctgtctgaaagctttgcaaccttttatcaagcatcagacgaacagacagatgacagcgaagttgatctgttcttaagcaaaatcacggagcattcctgccagacgtgctacaagaaaaacaggtgctgggtacagaactttgataaaacatatgacttaatgaaacaagttatgcttgaaacagaggaaaaagaatatgcatcaaaccgaaggctgaaaaaagagtttcaacagtattgttctaaatccaagcaggttgaagatctgattgaggatgagctcgcacatcatcatgcccatttgacactcaagaaaaaagtccaagacagcaggcgccttgttgctgaacagcttttaggcgtttctgaagtcatggccgacttttctcgggaaataaaaagagagcgagaacagcactttctgcaggaagagcaaatcatagaggcgcttcaacatttcggaattgagattcagcatgtcgagatctatagtcttgaacaaggaaatatcgatattgaaatgaccattccgttcagcggacatggagaaagtgaaaaaatcattgcccctatgctgtctgacattctggaagaacaaattcttgtgaaagccgaacagcactctccgcatccgaatggatacagccatgtcgcctttggatcaacaaaatcatacagggtgtctacgggagctgctcacgctgcgaagggcggcggccttgtctccggcgacagctacagcatgatggagcttggagccagaaaatatgctgcagcaatcagtgacggaatgggcaatggcgcaagagcacactttgaaagcaatgaaacgatcaagcttcttgaaaaaatccttgaatcgggaattgatgaaaaaatagcaattaaaacgatcaacagcatactgtctctaaggacaactgacgaaatatattccacgcttgacctatctattatcgatcttcaagatgccagctgtaaatttttgaaggttggatcgacgcccagctttatcaaacggggtgaccaggtcatgaaagttcaagcgagcaatctgccaatcggtattattaatgaattcgatgtggaggttgtgagtgaacagctgaaagcgggtgacctcttaattatgatgagtgatggcatttttgaggggcctaagcatgtggaaaatcacgacttatggatgaagcgtaaaatgaaagggttgaaaacaaatgacccgcaggagattgccgatttgcttatggaagaagtcatccgcacaagatccggccaaattgaggacgatatgactgttgttgtcgtccggattgatcacaatacaccgaagtgggcatccattcctgttccggcaatctttcaaaacaaacaagaaatttcataacgcttccgtataaatcaaatttcttctggcgaagatgggaatatatgaatctgagaatcctcgtattctccaggaggaatgaatgtgaacaacggacatttaaatcaaattttgctgataacggatggctgctcaaaccatggggaagacccgcttgcaatggctgcttttgctaaagagcaggggattacggtaaatgtcattggtataatggaagaaaatcaaattgaccctgaggcaatgaaggaagtcgaagggattgcacttgccggaggaggcgtgcaccaagtcgtttatgcatctcagctttcacaaactgttcaaatggtaacaaaaaaagcgatgacgcaaaccttacaaggtgtagtcaatcaagaactgaaacagattctcggaaagaatgtggaaatggaagagctttctccggaaaaacgcggcgaagtcatggaagtggtagacgagcttggagaaacggtgcatcttcaggttttggttcttgttgatacaagtgcaagtatggcgccaaagcttccaacagtaaaagaggcgctgattgatttgtctgtaagcctcaattcccgaatcgggaataacgaatttgcgatgtgtatatttcccgggaaaaaacaagaggtcgagcttgtgctgaactggacaccgaagctgcaatctctttccacactctttgcaaagctttcgacaggcggcatcacgccgacaggtccggcgattcgtgaagcgacactgcagtttgaaaaaatacgctcaagaaggggcatgctggcagatgatgaacgacgctttgacgagtttggcatgtagcctcaagccgggtacgacaatcaaaggcaagtggaatggaaacacgtatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtgccaatacgaaagtttcattttatgcaatggaatacataaaagggccgctgcttttgaagtatgccagtgataaaggagcagagtggataccggtattaatgattcagctgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaacccgctgcttcaaaagtataaaaaagtgcttttttcagccttgaacggagaatatcaatccgcagatgaaatgaagaaggatatgctagacgcggggcaaaaagcagcacaaagaaaacagcctataaaagcatcaccgcagcctgccacacgacaaagacagcaaaaaccgcgccaaggaaaaataacgaagacgcgatataccccaaaacagaaaccggctaagtcggggggttatttgaaacaacgcttatcgtgatcagtgttttagcgctttatttcgcctatattatctttttcttaatctgaatggcgcaaactgcagagcctatgcttcttctttgcttggaggggttgaaagtgttaggatatgaatatctttaaaatacctgctcattgtgaggaggacattgtgaaaagtgtcaaagattttttaaacaaacacaatcttacgttaaaaggggcgacaatcattgtaggcgtttccggcggtccggactcaatggctcttcttcacgcgttgcatacgttatgcggccgttcagcgaatgttattgcagctcacgttgaccatcggttcagaggtgcggaatccgaggaggacatgcgttttgtccaagcttattgtaaagctgaacagctcgtgtgcgaaacggctcaaatcaatgtaaccgcatatgcacaggaaaaaggactcaataagcaggctgcagcacgcgattgccgctaccagttttttgaggaaatcatgtcgaagcaccaagcggactatctggctcttgcgcatcatggtgatgaccaggttgaaacaatgcttatgaaactggctaagggtacgcttggaacgggacttgcgggaatgcagccggttagacgttttgggacggggcggatcatcaggccgttcttaaccattacaaaggaagagatccttcactattgccgtgaaaacggcttgagctaccggacggatgaaagcaacgccaaagatgactacacaagaaacagattcagaaaaacagtgctcccgtttttgaagcaggaatctccggatgtgcataaaaggtttcagaaagtgagtgaagcactgacggaagatgagcaattcttacagtcattaacgaaagatgaaatgaataaagtaatcacaagccagtctaatacatcagttgaaatcaattcctctcaattgcttgccctcccgatgcctttacaaagaagaggagttcaactaatattaaactatctttatgaaaacgttccatcatccttttcggcccatcacattcagcaatttctcgattgggcggaaaatggcggtccttcaggagtactcgactttccgaaagggctgaaggtggtcaaatcatatcagacatgtttgtttacatttgaacaatggcagtgcaaaaatgttccctttgaataccaaattagcggagcttctgatgaaacggcagtgctccctaatggatatctgatagaggcaaagcattatgcggactcgcctgaagaacatgggaatgctgtttttatcacaagtgaaaaaaaggtgcgatttcccttaacaatccggacgagaaaagctggagaccggatcaaactaaaagggatgaacggctcaaaaaaggtaaaggatatatttattgataagaaactgcctctccaagaaagagacaactggccgattgtgacggacgcaagcggtgaaattatctggatacctggcttgaaaaaatcaatttttgaagatcttgtgattccaaacagcgaccgcattgtattacaatatagacagcatgaaaagtgtagggggcaagcaaaatcatgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctgatcggcagcctgcttccgagatggttattgtttgtattggaatgattttctatggtactattgaacatagttgtgcttactgtgggaggaggtaaggaatgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgctcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagcttggcgccagaataccgaaaggcgtgcttttagtcgggcctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgtcagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaatcacagtggaccgcccagatgtcattggccgtgaagctgtattgaaagtccatgcgagaaacaaaccgctggatgaaacggttaacctaaaatcaattgccatgagaacaccaggcttctcgggcgctgacttagaaaacctcttgaatgaagctgcgcttgtagcagctcgtcaaaacaagaaaaaaatcgatgcgcgtgatattgacgaagcgacggaccgtgtaattgccggacccgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacggaattcggtatgtcagaaaaactgggaccgttgcaatttggacagtctcagggcggtcaggtattcttaggccgtgatttcaacaacgaacagaactacagtgatcaaattgcttacgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacagatcaaacaccttatcgatcatggaacattacctgagcgtaatttctcagatgatgaaaagaacgatgatgtgaaagtaaacattctgacaaaaacagaagaaaagaaagacgatacgaaagagtaattcgctttctttctaaaaaaactgccggctgacgctggcagtttttttatgtaaattatgggctcagctgcggcttttacaatcatccaattctggtatcgatttgtttacaaatgagccgctgatcgtgtatggtattgtagaatgtttgtaaaaagtaaagtagagaaactattcaaaagtggtgatagaggttgttactggttatcgatgtggggaacaccaatactgtacttggtgtatatcatgatggaaaattagaatatcactggcgtatagaaacaagcaggcataaaacagaagatgagtttgggatgattttgcgctccttatttgatcactccgggcttatgtttgaacagatagatggcattattatttcgtcagtagtgccgccaatcatgtttgcgttagaaagaatgtgcacaaaatactttcatatcgagcctcaaattgttggtccaggtatgaaaaccggtttaaatataaaatatgacaatccgaaagaagtgggggcagacagaatcgtaaatgctgtcgctgcgatacacttatacggcaatccattaattgttgtcgatttcggaaccgccacaacgtactgctatattgatgaaaacaaacaatacatgggcggggcgattgcccctgggattacaatttcgacagaggcgctttactcgcgtgcagcaaagcttccgcgtatcgaaatcacccggcccgacaatattatcggaaaaaacactgttagcgcgatgcaatctgggattttatttggctatgttggccaagtggaaggaatcgttaagcgaatgaaatggcaggcaaaacaggaaccaaaggtcattgcgacaggaggcctggcgccgctcattgcaaacgaatcagattgtatagacatcgttgatccattcttaacccttaaagggctggaattgatttatgaaagaaaccgcgtaggaagtgtataggaggtttagtaatggattatttagtaaaagcacttgcgtatgacggaaaagttcgggcttatgcagcgagaacgactgatatggtaaatgaggggcagagacgccatggtacgtggccgacagcatccgctgcattgggccgcacaatgacagcttcacttatgctcggcgctatgctgaagggcgatgataagctgaccgtgaaaatcgagggcggaggtccgatcggagctattgtagctgatgccaatgccaaaggagaagtcagagcctatgtctctaacccgcaagttcattttgatttaaatgaacaaggcaagcttgatgtcagacgtgcggttggaacaaacggaacgttaagtgtcgtaaaagatttaggtttgcgcgagttcttcacaggacaagtagaaatcgtttcaggagaattaggcgatgatttcacttactatcttgtgtcatctgagcaggttccttcatcagtgggcgtaggtgtgctcgtaaatcctgacaataccattcttgcggcagggggctttattattcagctgatgccgggaacagatgatgaaacaatcacaaaaattgaacagcgtctatctcaagtagagccgatttctaagctcatccaaaaagggctgacaccagaagaaattttagaagaagtcctaggcgagaaacctgagattttggaaacgatgcctgtcagattccattgcccttgttcaaaagaacggttcgaaacagccattttaggactaggcaaaaaagaaattcaagatatgatagaagaagatggacaagccgaagcagtatgccatttttgtaatgaaaagtacttatttacaaaagaagagctggaagggcttcgtgaccaaactacccgctaagctctttagcgggtttttaatttgagaaaaggggctgaaagcaggtttgaaatcaagaacaatctggaccattattttaggggcgctgttggtttgctgtattgctgttgcatatacgctgacgaaatcccaaaccggcgcatcgtcatccggtgagtctattgcgactatcggaggcaagagtgtgacaagagaagaatggctgaaagaaatggaagatcagtatggtaagtcaacgcttgaagatatgatcaatgtccgagttgttgagcagctggctaaaaagaacaaccttaaaatatccaaaagcgaagttgatcgtgagtttttgctgattaaagcggtcaataattccttttacgaagatgaacatacgacggagaaagagtggaaagaccaaattcgttataatatcctccttgaggaattgttaacaagggatatcgatatctcaaacaaagaactggaatcattctataataaaaataaggaactatatcagtttgatgattcgtatcgaattcggcacattgttgtaaaagatgaagaagaagcaagagaagtcctgaaagaactgaaaggcggatcaagctttgaagctgtcgctgccgaaagatctacagacagatatacatcaccatacggcggagatttaggttttgtcacagaggcatcagacaacattccatcagcatacattgaagaggcgaaaacactcaaagaggatgaatggtctcaggaaccaataaaggtcagcaatggatatgccattatccagctgaaagaaaaactaaaggcaagaacgttctcatttgatgaagtaaaggaccagatcagacggcaaatcgcaatggatcagttaggcgataaagcgacagttaagaccctttggaaagaagccgatgtatcttggttttatggggaaaaaagtactaagtgattgacaaaaaattttgaaattgatagattatatacataataccaatacaaatagtcggaaattgaggtgtcgagaatggtacgtgtagcaaactccattactgaattaattgggaatacgccaatcgttaaattaaatcgccttgcagatgaaaacagtgcggatgtatatctaaaacttgaatacatgaaccctggaagcagtgtaaaagaccgtatcggtttagccatgattgaagcggctgaaaaagaaggaaaattaaaagccggtgatacaatcattgaaccgacaagcggaaatactggaatcgggcttgcaatggttgctgctgctaaaggattaaaagccattttggttatgcctgatacaatgagcatggagcgccgcaaccttcttcgcgcatacggtgctgagcttgtgctgactcctggtgcggaaggcatgaaaggtgccattaagaaagctgaagagcttgctgaaaagcacggatactttgtgccgcagcagtttaacaacccttctaacccagaaattcaccgccaaacaacgggtaaagaaatcgttgagcaattcggtgatgaccagcttgacgcatttgtagccggaatcggaacgggcggaacgattacgggagcgggcgaagtgctgaaggaagcgtacccttccattaagatttatgctgttgaaccgtcagattccccagtgctttcaggaggaaaaccaggcccccacaaaattcagggaatcggagctggattcgtgccggacatcttaaacactgaagtatatgatgaaatcttccctgtgaagaatgaagaagcattcgaatatgcccgcagagctgcacgtgaagaaggaattctcggaggcatctcatcaggtgcggcaatttatgctgctcttcaagtagcaaaaaaactcggaaaaggcaaaaaagtattggccatcattccaagtaacggcgaacgttatctaagcacgccgctgtatcaattcgattaaaaaaagccaaaactcccggtccgccgggagtttttttatatttcgtgcatcaaatatgccatgtctgcgacgaatgttattcttggaagagaaattcacttttttcactaacaacattgctttacaattaaaaacaagtaaaaaagaaaatagaggaatgatacaaatggcacaacgcagaccggcaggcaaaaaaataccttttcaaaaagactcattcttacaacaatttgagaaacttgcgcaatcccggaaacatcatgtacttctcgaaagtgcaagaggcggcagatatagtatagccggtcttgatccaattgcgactgtgaaaggaaaagacggaataactacaattaagcatggtgatgagatgctgtttaaagaaggtgatccattacgggccttccacagctggtttaaaacactggaaacagaaacgaatcatgagttccctgactttcaaggcggggcaatcgggtttctcagctatgattacgcacggtacattgaaaattttaaaatgctctcattagatgatctagaaacaccagatatttattttcttgtttttgatgatatagcagtttatgaccatcaagaagagtctctatggctgattactcatgttaatggttctgatcaggaaacagcggatgtgaagctatctgagttagagcagatgtggctgactgagcttcccgctgtctcttcgcgagagatgaaccctgaaacagatggttctttcgcggcgccatttaccgaggatgggttctcacaagctgtagagaaaatcaaacaatacattgccagcggagatgtgtttcaagtcaatctatcaataaggcagtcacagtcactgtctgcccacccatatcaaatttacaaaaccttgagagaagtaaatccttctccttatatggcgtatttagaaacacctgatttccaaatcatttgcggatcgcctgaactgcttgtcagcaaaaagggcaagctattagagacaagaccgattgcgggcacccgttccagagggaaaacaaatgaagaagacgaggcgcttgcaaacgaattgatacacaatgaaaaagaacgcgcggaacatgtcatgctggttgatcttgagcgaaatgatctgggaagagtatcacgttacgggtctgtgcgcgtaaatgaattcatggcaattgaaaaatactcgcatgtgatgcacattgtgtctaatgtccaaggtgaactgcaggatgggtatgatgctgtagatattattcatgctgtgtttcccggaggaaccattactggtgcaccgaaagtaagaacgatggaaattatagaagaacttgagccgacacgccgagggctttatactggatctataggatggtttggatataatcacgatctgcagtttaatatcgtcattcgaaccatttatgcaaccggagggcaggcatttatgcagtccggcgcaggagttgtgattgattctgttccgaagcacgaatacaaggaatcattcaaaaaagcttttgcgatgcaaagagcattagagctgagcaaagaagagacaaaaattagatgaggtgagcggagaaatgattttaatgattgataactacgattcattcacgtacaacttggtacagtatttgggcgagcttggggaagagctggttgtgaaacgcaatgacagtatcacaatcgaagaaattgaagaactgtctccggactttctgatgatatctcccggaccgtgcagccctgatgaggcgggaatcagcctcgaagcaattaaacatttcgcagggaaaattcctattttcggtgtatgtctcggacatcagtccatcgcacaagtgttcggtggtgatgttgttagggcagaacggcttatgcacgggaaaacctcggatatcgagcatgacggcaaaaccatttttgaagggttgaaaaacccccttgttgcgacgcgataccactcgctgatcgtaaaacctgagacgctgccaaactgttttacagtaacagcacaaacgaaagaaggagaaatcatggctattcgccacaatgacctcccgatagagggcgtgcaatttcacccagagtctattatgacctcctttgggaaagaaatgctcagaaattttattgagacatatcgcaaggaagttattgcgtgatgatatatgtgaacggccggtatatggaggagaaagatgcagttctttctccttttgaccatgggtttttatatgggatcggtgttttcgaaaccttcaggctctacgaaggctgcccgtttttgcttgattggcatatagaaaggcttgaacgcgcgcttaaggatctgcaaatcgaatatactgtttcaaagcatgagatccttgagatactggacaagctgcttaagctaaatgatatcaaggatggcaatgcccgcgtcagactgaacatatcagcggggatcagcgataaaggctttgtcgcccagacgtacgataagccgaccgttttatgctttgtgaatcagctgaaaccagaaagccttcctttgcaaaaagaaggaaaggttttatcgatacggagaaacactccagagggatcgttccggttaaaatctcatcattatctaaataatatgtatgcgaaacgggaaattggaaatgatccgcgtgtcgagggaattttcttaacggaggatggagctgttgcagagggtatcatatctaatgtcttttggagaaaaggtcgttgtatctatacgccatcgcttgatactggtattctggacggcgtcacgagacgttttatcatagaaaatgcaaaggatatcggcctggagctcaaaacgggccgatatgagctagaagctctcttgacagctgacgaagcgtggatgacgaactcggttcttgaaatcatcccgtttactaaaatagaagaagtaaactatggaagccaaagcggagaagcaacctccgctcttcaattgttatacaaaaaagaaataaagaacatgatgtatgaaaagggaggaagagcatggcgcagcacacaatagatcaaacacaagtaatccacactaagcccagcgctttatcatataaagagaagacgctggtgatgggaattttaaacgtaacgcctgactctttctcggacggtggaaaatatgacagcttggacaaggcgctgctgcacgcgaaagagatgatcgatgatggtgcccatatcattgatatcggaggggaatcgacaaggcctggcgctgagtgcgtatctgaggatgaggagatgtccagagtcattccggtgattgagcggattacgaaagagcttggtgttcctatttctgtagatacgtacaaggcttctgtcgcagatgaagcagtgaaagccggcgcatccattatcaatgatatttggggagccaaacatgatccgaagatggcttccgttgcagctgaacataatgttccaattgttctcatgcataaccgccctgaaagaaactacaatgacttattgccggatatgctgacggacttaatggagagtgtaaaaattgctgttgaggccggagtagacgagaagaacattattcttgatcccggtatcggtttcgcgaaaacctatcacgataacttggcagtgatgaacaaactagagattttcagcgggctgggatatccggttcttctggcaacctcccgaaaaagattcatcggacgtgttctggatcttccgcctgaggagcgggctgagggcacaggcgcgactgtgtgtctcggcattcaaaaaggctgtgacattgtcagggtccatgatgtaaaacaaattgccagaatggcgaaaatgatggacgcgatgctgaataagggaggggtgcaccatggataaagtttatgtagaaggtatggagttttacggatatcacggtgtgttcaaagaagaaaacaaacttggccagcggtttaaagtcgatttaaccgctgagctggatttaagcaaagctggacaaacagacgaccttgagcaaacgatcaactatgctgaactctatcacgtatgtaaagatatcgtggaaggggagcctgtaaaattggtggaaacgctggcagaacgtattgctggcactgttctcgaaaaatttcagcctgttcagcaatgtacggtaaaagtgattaagccagacccgccaattcccggacactataaatcagtagcaattgaaattacgagaaaaaagtcatgaacaacatagcttatattgcacttggatctaatattggagatagagaaacgtatttaaggcaagcagtggcttcactgcatcagcatgctgcggtgacagtcactaaagtgtcgtctatttacgaaactgacccggtcggatacgaagatcaagctcaatttttgaatatggctgttgaaatcaagacatcattgaacccttttgaactccttgaactgacgcagcagatagaaaatgaattaggcagaacaagggaagtaagatgggggccgcggacggcagaccttgacattttgttatttaatcgtgaaaatattgaaacagagcaactaattgttccgcatccgagaatgtatgagcgtttgtttgtccttgcgccgcttgcggaaatttgccagcaggttgaaaaagaggctacaagcgccgaaacagaccaagaaggtgtaagagtatggaagcagaaatctggggtagacgaattcgtgcattcagaaagctgaaaggttatactcaagaaggatttgcaaaagcattaggtatatcagtttctattctcggcgaaattgaacgcggaaaccgattgccgtcagctgccatcattcaagatgcagcagatgttttaaatataagtgcggacgaattggcgccgccagaaaaatagaacaaatgaaaggaggagaaaaattgttcaaaatcggagatattcaattgaaaaaccgggttgtgctcgcacctatggctggtgtctgcaactctgcgttcagattgactgtaaaggaattcggagccggattggtatgcgctgaaatggtcagtgacaaagcgatcctttacaacaatgcaagaacaatgggtatgctttatatcgatgaacgtgagaaaccactcagccttcaaattttcggaggaaaaaaggaaacccttgtggaagcggcgaagtttgtagaccaaaacacaactgctgatatcattgacattaacatgggatgtcccgtgccgaagattacaaaatgcgatgcgggagccaaatggcttctcgatcctgataagatttacgaaatggtttctgcagtagtggatgctgttaataagccagttacagtgaaaatgagaatgggttgggatgaagaccacattttcgcagtgaaaaatgcacaggctgtagaacgtgcgggcggtaaagcagttgcgcttcacggccgtacgagagtgcagatgtacgaaggaacggcaaactgggatatcatcaaagaagtaaaacaatcagtatcgattccggttatcggaaacggcgatgttaagacaccgcaggatgctaagcgtatgctcgatgagacaggagtagacggggtcatgatcggacgcgctgcattgggcaatccgtggatgatttaccgtacggttcagtatcttgaaacaggtgaattaaaagaagagccgcaagtacgcgaaaaaatggccgtatgcaaactgcatcttgaccgcctgattgacttaaaaggtgaaaacgtagcggtaagagaaatgagaaagcatgctgcatggtatctgaaaggcgtgaaaggcaatgcgaacgttcgtaatgaaatcaatcattgcgagacgagagaagagtttgtacagcttttagatgcgtttacggttgaagttgaggcaaaagagcttcaaaatgcaaaagtaggataatactcacctctatttgctgctcactgctagttttacgctggcagtttttctgcttttttcatgaaacaatatctgtaatggagtgataacaatgagtcaagaagagcataaccatgaagaattgaatgatcagctgcaagtcagacgcgataaaatgaatcagctgagagataacggcatcgatccattcggcgcacgttttgaaagaactcatcagtctcaagaagttatttcggcatatcaagatctaaccaaagaagagttagaagaaaaagcgattgaagttacaatcgcaggccgcatgatgacaaaacgcggcaaaggaaaagccggctttgcccatcttcaggatttagaaggccaaatccaaatctacgtaagaaaagacagtgtcggtgacgaccaatatgaaatcttcaagtcttctgacctcggtgatcttatcggcgtaaccggaaaagtcttcaaaacaaatgtaggcgaattgtctgttaaagcaacttcctttgaattgctgacaaaagcgcttcgtccgcttcctgacaaataccatggtttaaaagacgttgagcagcgctaccgtcagcgctacctggatcttatcgtaaacccagacagcaaacatacgttcattacacgaagcaagatcattcaagctatgagaagataccttgatgatcatggatacttagaagtagaaacacctacaatgcacagcattcctgggggagcttctgcacgtccgtttatcactcaccacaacgcgttagacattccactctatatgcgtattgctatcgaactgcacctaaaacgtctaattgtcggcggtttagaaaaagtatatgaaatcggccgtgttttccgtaacgaaggagtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgactggcgttgatttctgggaagaggttactgttgagcaggcgcgtgaatatgcaaaagaacatgaagtagaaattaaagactctatgacagtaggccatatcatcaacgaattcttcgaacaaaaaattgaagaaacgcttattcagccaacgtttatttacgggcatcctgtagaaatttctcctcttgctaagaaaaaccctgaggacccgcgttttacagaccgttttgagctgtttatcgttggccgtgaacatgccaacgcgtttacagagctgaatgatcctattgatcaaagagaacgctttgaagcgcaattaaaagagcgtgaagccggtaatgatgaagctcatctaatggatgaagactttgttgaagctctggaatacggtatgccgccaacaggaggtttaggcatcggtatcgaccgtctggttatgctgctgacgaatgccccttctattcgcgatgtgctgttattcccgcaaatgagacaacgctaataaagaagagcggtattctccatatagaaaggatgccgctctttttaaattccttagtatttcttcaaaaaaactattgcactattatttactaggtggtatattattattcgttgccgctaaacaaggcgataacgaaaaaataacttaaaaaaagttattgacttcactgggtcaacgagttataataataaagtcgcttgaacgaagtgaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccacattttgaatgatgtcacacctgttatctagttttgagagaacactctcaatttgtttggtggcgatagcgaagaggtcacacccgttcccataccgaacacggaagttaagctcttcagcgccgatggtagtcggggtttccccctgtgagagtaggacgccgccaagcaattgcacgttagtgcaagtatggaggattagctcagctgggagagcatctgccttacaagcagagggtcggcggttcgagcccgtcatcctccaccattatgccggtgtagctcaattggtagagcaactgacttgtaatcagtaggttgggggttcaagtcctcttgccggcaccacttttatatgatataatactcaagtctcttgtagaagagccattagctcagttggtagagcatctgacttttaatcagagggtcgaaggttcgagtccttcatggctcaccattttatgcgggtgtggcggaattggcagacgcgctagacttaggatctagtgtctttatgacgtgggggttcaagtcccttcacccgcattatataggataacagttagaaaaactggacatcctgtctgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattatgttttgcgcccgtagctcaattggatagagcgtttgactacggatcaaaaggttaggggttcgactcctctcgggcgcgccatatcttttaatagaatagatagggaatcgggaagtagctcagcttggtagagcacatggtttgggaccatggggtcgcaggttcgaatcctgtcttcccgaccattttttgtggggccttagctcagctgggagagcgcctgctttgcacgcaggaggtcagcggttcgatcccgctaggctccaccaaaagtttttaaaaaagttgttgactttgaagaagtgacgttgtatactgataaagttgctttaacaaagcaagcaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccacattttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagctaaacccagctcattgagctgggttttttgtattttggtttattggtatcataaaattccacttaactgtataatataataactttataccgaattttaaatcagctatcaggttttgtggaccgggaaaatggaaataataaaggatagagcgagaaagttgaaaattctcgagaaacggcttatagtaagattaaagtcaaatatagtcaaagtcagtaaaggaggggttgagtgggacataatatttctgacatcattgaacaatatttaaaacgagtgttagatcaaaatggcaaggaaattttagagattaaacgaagtgaaattgcagataaatttcaatgcgttccttcccaaataaattatgtcatcaacaccagatttacaagcgaaagaggatatattgttgagagcaaacgcggggcggcggttatatcagaatcattaaaattaaaatgaacaatgaagttgtcctgatcaataatattatttctcaaattaatacccatttgtctcaagcagcctctgatgacattattttaaggctattagaagacaaggtaatttcagaaagagaagcaaaaatgatggtcagcgtaatggaccgctcagttttacacattgacttgcctgaacgtgatgaattaagagcgagaatgatgaaggcaatgctgacttctttaaaattaaaataagcgggtgaaaagattgatttgtcaagagtgccacgagagaccagccacttttcactttacaaaggttgttaacggagaaaaaatagaagttcatatttgtgaacaatgtgccaaagaaaatagtgattcatatggtataagtgcaaatcagggtttctctattcataatttactttcgggtttactgaacatggattcttcatttcaaaatgcaggaactcaaatgttcagtcactcggagcaaatatctgcttgtccgaaatgcggaatgacttttcagcaattcagaaaaattggccgttttggatgttctgaatgttacaaaacatttcatagcaacattacaccaatcctacgtaaagtgcacagcggaaacactgtgcatgcaggtaagataccgaaacgaataggcggcaatcttcatgtcagacggcagattgatatgctaaaaaaggaattagaatccttaatccatcaagaagaatttgaaaatgcagctcatgtaagagatcaaattcgttcattagaacaatcactcaaaagtacagatagtgaggaggaacaggggtaatgtcgctaaagcattttattcaggacgcactaagcagttggatgaagcagaaaggacctgaaagtgacattgtactcagcagccgcatacgtttagcaaggaactttgagcatattcggttccctacgcggtattccaatgaagaagcctcatccatcatacagcaatttgaagatcagttttcagagcaagaaattcccggaatcggcaaatttgttttgattagaatgaatgatgcacagcctttagaaaagcgtgtacttgttgaaaaacatctaatcagtcctaatctgacagagtctccttttggcggctgtttgctttctgaaaatgaggaagtaagcgtcatgctaaatgaagaggaccatattagaattcagtgtcttttccctggatttcagcttttagaagcaatgaaagccgcaaaccaggtcgacgactggattgaagaaaaagttgattatgcattcaatgagcaaagaggatacttaaccagctgtcctacaaacgtaggtacaggtttaagggcttcggtcatgatgcatctgccggcactggttttaactaggcaaataaatcgaattataccggcaattaatcaattaggcttagttgttagaggaatttatggggaaggcagcgaagcagtagggaatatctttcaaatttcaaatcagatcacgcttggtaagtcagagcaggatattgtagaggatcttaacagtgttgctgctcagttgattgaacaagaacgatctgcccgagaagcgatttatcaaacttctaaaatcgaacttgaggatcgggtatatcggtcttatggggtcttgtctaattgccggatgatagaatcgaaagaaactgcaaagtgcctttcagatgttcggttaggcatagacctaggtattataaaaggactttcaagcaacatacttaacgaacttatgattttgacgcagccagggtttttacagcaatactcgggaggcgctttgcgtccgaacgaaagggacattcgaagagcggctctcatcagagaacggcttcacttagaaatgaatgggaaaagacaggaggatgaatcgatatgatgtttggaagatttacagaacgagctcaaaaagtactggcgctagcacaggaagaagcacttcggttaggtcataataacattggcactgagcatattttattaggactggtaagagaaggagagggcattgctgctaaagctcttcaagcgcttggactcggttcagataaaattcagaaagaagtagaaagtttgatcgggcgcgggcaggaaatgtctcaaacgattcattatactcctagagctaaaaaagtcattgagctttcaatggatgaggcaagaaaactcggtcattcttatgtcggaacagaacatattcttcttggtctgattcgtgaaggagaaggcgttgctgcgagagttctgaataatctcggtgtcagcttaaataaagcaagacagcaggtgctccagcttctaggaagtaatgaaacaggatcatcagcggcaggaacaaacagcaatgcgaatacgcctacgcttgacagcttggcaagagacttaactgctattgcgaaggaagacagccttgaccctgtaatcggcagaagcaaggagatccagcgtgtgattgaagtattaagccgcagaacgaaaaacaaccctgttctcattggggaaccaggtgtaggtaaaacggctatcgcagaaggtttggcacagcaaattatcaataatgaagtacccgaaattttgcgtgataaacgtgtgatgacattagacatgggaacagttgttgccggcacaaaataccgcggagaatttgaggatcgcctgaagaaggtcatggatgaaattcgccaggcaggaaatatcattctattcatcgatgagctccatacattaatcggggcaggcggagcagaaggtgctattgatgcatctaatattttaaaaccttcacttgctcgcggcgaactccaatgtattggtgcaacgactcttgatgagtaccgtaaatatattgaaaaagatgcagcactggaacgccgttttcagccgattcaggttgatcagccatctgtagatgaaagtattcaaattttacaaggtctgcgtgacagatacgaagcccaccaccgcgtttctatcactgatgatgccattgaagctgcggttaagctttctgacagatatatttctgaccgcttccttccggataaagcaattgacttgatcgatgaagcaggttcaaaggtgagactgcgctcatttacaacgcctcctaacttaaaagagcttgagcagaagcttgatgaggttcgtaaagagaaagatgcggcagtgcaaagccaagagtttgaaaaagctgcttccttgcgtgatactgaacaacgcctgcgcgagcaagtagaggatacgaagaaatcatggaaagagaagcaagggcaggaaaactcagaggttactgtggatgatatcgcgatggttgtatccagctggaccggtgtgcctgtatctaaaattgcccaaactgaaactgataagcttctcaatatggaaaacattcttcactcccgcgtcatcggccaggatgaggcagttgtagctgttgcaaaagccgtcagacgtgcgagagcaggattaaaagatcctaaacgcccaatcggctcattcattttcttaggccctacaggtgtaggtaaaacagaacttgcacgagcacttgctgaatccatttttggcgatgaagaatccatgatcagaattgatatgtctgaatacatggaaaaacactcaacttcaagacttgttggttcacctccgggatatgtgggatatgatgaaggcggtcaattgacagagaaagtcagaagaaaaccttactctgtcgtgcttcttgatgagatcgagaaagcgcaccctgatgtcttcaatatccttctgcaagttcttgaagacgggcgattgactgattctaaaggacgcacagtcgatttccgcaataccattctgatcatgacatcaaacgtcggagcaagtgagctgaaacgcaataaatatgtcggctttaacgttcaggatgaaactcaaaatcataaagacatgaaagataaagtgatgggtgaattgaaacgagcgttcagacctgagttcatcaaccgtattgatgaaatcattgtcttccattcacttgagaaaaaacatcttactgaaattgtgtcattaatgtctgatcaattaacgaaacgcctgaaagaacaagatctttctatcgaattgacagatgctgcaaaagcgaaagtcgcggaagagggcgttgacctggaatacggtgcccgtccgttaagaagagcgatccaaaaacatgtcgaggatcgtttatctgaagaactcctcagaggaaatattcataaaggacagcatattgttcttgatgtagaagatggcgaatttgtcgtaaaaacgactgctaaaacgaattaatatagaagacggaaatgaggcatacagcatgtaagtgtatgcctcactttcatatcaagaaatagaacaagggagaggtcttacactatatatggctaaaacaaaatcgaaattcatctgccaatcctgcggctacgagtctccaaaatggatggggaaatgtccgggctgcggtgcttggaatacaatggtggaagaaatgattaaaaaagcaccggccaatcggagagcggctttttctcattctgttcaaactgtacagaaaccttcacctattacatcaatcgaaacatcagaagaaccccgcgtcaaaacccagcttggcgagtttaacagagtactcggcggaggtgtcgttaaaggctccctcgttttaattggcggtgatcctggtatcggaaagtcaacgctattactgcaggtttccgctcaattatcaggctcatcaaacagtgtcctgtatatttcgggagaagaatctgtaaagcaaacgaagctgcgagcagaccgtctcggcattaataatccgtcactgcatgttttatctgaaaccgatatggagtatatttcgtctgctatacaagagatgaatccagcgtttgtcgttgttgactctattcaaacggtttaccaaagcgatattacatcggctccaggcagtgtgtcacaggtcagagaatgtaccgctgagctgatgaaaattgcaaaaacaaaaggtattccgatttttatcgtagggcacgtgacgaaagaagggtctattgcaggtccgagactgttggagcatatggttgacactgttttatattttgaaggagaacgccaccatactttccgtattttgcgggctgtaaaaaaccgtttcggatctacaaacgaaatgggcattttcgaaatgcgggaagaggggctcactgaggttttgaatccttcggaaattttcttagaagaacgctctgctggttccgcaggctcgagtatcactgcctctatggagggcactagaccgattctcgttgaaattcaggcgctcatctcgccaacaagttttggcaacccaaggcgtatggcaacgggaatagaccataacagggtttctctgttaatggctgtgttagaaaaaagagtagggctgctgctgcaaaatcaggatgcttatttgaaagtggctggcggcgttaagcttgatgaaccggcaattgatcttgccattgcgattagtatcgcatcaagctttagagacacacctccaaatcctgcagattgttttattggagaagtgggattaaccggagaagtccggcgggtttcaagaattgaacagcgtgtgaaagaagcggcaaagcttggttttaaacgcatgatcatacccgcggcaaatctggatggatggacaaaaccaaaagggattgaggttatcggagtagcaaatgttgcagaagcgcttcgtacttcattaggaggataatagatggaaaaagagaaaaaaggggcgaaacacgagttagacctgtcatctatattgcagtttgttgctccgggtacaccgctcagagcggggatggaaaacgtcttgagagcaaatacaggcggtctgattgttgttggatataatgataaagtaaaagaagtagtggacggcggctttcacataaacacggctttttctccggcgcatttatatgagctggctaaaatggatggagcgatcattttaagtgattctggtcaaaagatcctctacgcgaatactcagctgatgccggatgccacaatttcttcatcagaaacaggaatgcggcacagaactgccgaaagagtagctaagcaaactggctgtcttgtaatcgctatttctgaaagaagaaatgtcataacgttatatcaggaaaacatgaagtatacactaaaagacataggatttattttaaccaaggcgaaccaagccattcaaacacttgaaaaatataagacaatcctcgataaaacgattaatgcactgaacgcgttagagtttgaggaacttgttaccttcagtgatgtcttgtctgtcatgcatcgttatgaaatggtactgagaatcaaaaacgaaattaatatgtatatcaaagagctggggacagaaggacatttgatcaaactgcaagtcattgaattgattacggatatggaagaagaggccgctttatttattaaggactatgtaaaagaaaagattaaagatccgtttgttctcttgaaggagctgcaggatatgtccagttatgatctgctggatgattccattgtgtataagcttctcggttaccctgcttctactaatcttgatgattatgtattgccgagaggatacaggctgttaaataagataccgcgtcttccgatgccgattgttgaaaatgttgtagaagcatttggagtcctaccaaggattattgaggcgagtgcagaagaattagatgaagtagagggaatcggtgaagtacgagcccaaaaaatcaaaaaaggattaaaacgcctgcaagagaagcattatttagacagacaactgtgatttcggttaaaaccttatgaatacgggtatattaatgttggtttttgtttattctgatattcgtaggatgcataagactttgtgaaattaaaatgttaaaaaaggaggtgggggtatgttaaaacgaatagttcaggcgttcttcattatttttggcggcgttgttggtatatttttgatacctgaattgtttgtactgttaaatatacaggacatacctttaataacaaacgcatatacgtctgcggcaataggagcaattatcttttttctcatcagtatatggggtacagaatacgttgtgaactgggtgaagtggatagaggattcattgttaaaagcgccggttccagatttgttatttggaagtcttggcttagtttttggacttataattgcttatcttatcgtaaatgttattcctttagacaatataccttaccgcatattcagcacaataattcctgtatttttggctttcttcctcggttatctcggcttccaggtgggctttaagaaaaaggatgaattgatcagcctgttttccatttccgccagaatgcaaaagaaaaaaggaacagctgatgaagaacatgaggttcaagacaagaagctgaaaattttggacactagtgttattattgatgggagaatagcagatatttgtcagactggttttttagagggagttatcgtgattccgcagtttgtccttgaggaattgcagcatattgcagactcttcagatgttttaaaacgaaacagaggacgccgcggtcttgatatcctgaaccgcattcagaaagaattagacattgaagttgaaatttacgaaggcgactttgaagatattcaggaggttgacagcaagctcgtcaaacttgctaagctgacatccggggtcgtcgtgacgaatgattttaatttaaataaagtgtgcgagcttcagaaggtagcagtattaaacattaatgaccttgccaatgcggtcaagcctgttgtgcttcctggcgaggaaatgaatgttcaggtcattaaggacgggaaagagcataatcagggagttgcctacttggatgacggtacgatgattgtcgttgaagaaggacggaattatatcggcaagcatattgatgtacttgtcacaagtgtgctgcagacagcagcgggacgaatgatttttgcgaagcctaagctgttggagaaggcgctctaaagggagaagaaacaatgagttatgatgtggtgattcctgcagccggacagggaaagcggatgaaggcagggagaaataaactgttcattgagctgaaaggagacccggtgatcatacacacgttaagagtgtttgacagccaccggcagtgcgataaaatcattttggtgattaacgaacaggagcgggagcactttcagcaattgctgtgcgattacccgtttcaaacttcaattgagcttgttgcaggcggagaagagcgtcagcacagtgtgtataaggggctgaaagccgtaaagcaagaaaagattgtccttgtacatgacggtgcccgcccatttataaaacatgaacaaattgacgaactgatcgcagaggcggaacagacaggagcggccatccttgctgttccggtaaaagatacgattaaacgcgttcaagatttacaagtcagtgagacgattgaacgttcaagcttgtgggctgtccaaacgccacaagcttttcgtctttctttattgatgaaggctcacgctgaggccgagcgcaagggatttttagggacggatgacgccagcctcgttgaacagatggagggcggttcggtccgtgttgtagaaggcagctatacaaatattaagctgacgacgccagacgatttgacgtcagctgaagctatcatggaatcagaaagtgggaataaacatgtttagaattggacaaggatttgatgtgcatcaattagtggagggccgtcctctcattattggcggaattgaaatcccgtacgaaaaagggctgcttggccattctgatgcagacgtattgctgcatactgtcgctgacgcctgcctgggagctgtgggtgaaggagacatcggcaagcattttcctgacacagatcccgagttcaaggacgcagattctttcaaattacttcagcatgtctggggaatcgtgaaacagaaggggtatgtccttgggaacattgattgcaccatcatagcgcaaaagccgaagatgctgccgtacatagaagatatgagaaaaagaattgctgaaggccttgaggcagatgtttctcaagtaaatgtaaaagcaacaacgacagaaaagcttggatttacaggccgggcggaaggaatagcggcacaggcgacagtactgatacaaaaaggctaacttgttttgatgccgggtctatttggtggtagaatagattcatacatttttgcctgaggccatacatgacatgaaaggaagtatttgaaaatgggaaacgaagtacgcgtccgttatgcaccgagtccaaccggacatttgcatattggaaatgccagaacggcgctttttaattatttatttgcccgcaatcaaggcggaaagtttatcattcgagttgaggatacagataaaaagcgcaatattgagggcggagaacaaagccagctgaattatctgaagtggctaggtattgactgggatgagagtgtggatgtcggaggagagtacggcccataccgtcagtcagagcgtaacgatatctataaagtgtactatgaagagcttcttgaaaaagggcttgcttataaatgttactgtacggaagaagagcttgaaaaagagcgtgaagaacagattgcccgcggagaaatgcctcgttattccggaaaacacagagacctgactcaggaagaacaggagaaatttatcgctgaaggcagaaaaccaagtattcgtttccgcgtgccggaaggaaaaattatcgccttcaatgatatcgtaaaaggcgaaatttcttttgaatcagatggcatcggcgacttcgttattgttaaaaaggacggaacgcctacttataacttcgcggtagcgattgatgactacttaatgaaaatgacacacgtgctgcgcggtgaggatcatatttctaacacaccgaaacagattatgatctatcaagcattcgggtgggatattcctcagttcggacacatgacgctgatcgtaaacgaaagccgtaaaaagctcagcaaacgtgatgaatccattattcaattcatcgagcagtacaaagagcttggctacttgccagaagcgctgttcaactttatcggactgctaggctggtcaccggttggagaagaagagcttttcacaaaagagcagtttattgaaatttttgatgtaaatcgtttatctaaatcaccagctttgtttgatatgcataagctaaaatgggttaacaaccaatatgtgaagaagctggatcttgatcaggttgttgaactgacgcttccgcatttgcaaaaagcgggcaaagttggcactgagctttctgctgaagaacaagagtgggttcgtaaactgatttccctgtatcatgagcaattaagctacggtgcggaaattgttgagctgactgatttgttctttacggatgagatcgagtataatcaagaagcgaaagctgttctggaagaagaacaggttcctgaagtgctcagtacattcgcagcgaagcttgaagagcttgaggagttcactccggataacatcaaagcatcgatcaaagcagtgcagaaagaaactggccataaagggaaaaaactgtttatgccgattcgtgttgctgtaacagggcaaactcacggtccggaactgccgcaatcaattgaattgatcggtaaagagactgcaattcagcgtttaaaaaatatctaaataaatgattgttgacagggaagagtataaagctttaggccattacagaaaggatctccattggctgagagagatccatgagccgggttttagaagtgcgcccttaagacctttgaagaacgttttttgaaaccagtattcaaaggcggccgccgccgttacaggctgaagttgggagagcagaagtctgcttttcaaacagagtggaaccgcgcggttaaagcgtctctgtcatgtttacatgcagaggcgctttttttattgggtagaggaaatcagatagagaaacgggggaagcatgtgttttttagaatgctcaaagaagacattgatactgtgttcgatcaagatcccgcagcaagaagctattttgaagtgattttaacttattccggtttacatgctatatgggcgcatcggattgcacatgctttatataaacgaaaattttatttccttgcacgccttatatctcaagtaagccgattttttaccgggatagaaatccaccccggcgctacaatcgggagaagatttttcatagaccacggcatgggggttgtcattggggagacatgtgaaatcggcaataacgtaaccgtttttcagggggttaccctcgggggaacggggaaagaaaagggaaaaaggcacccaacgattaaagatgacgcattgatagccacaggtgctaaagtgctcggttctattacggtcggtgaaggctcaaagattggggctggttcagtagtgctgcatgatgttcctgatttttcaacagttgtcggtatccctggacgggtcgttgtacaaaatggcaaaaaagtaagacgcgatttaaaccatcaggatttgcccgatccagttgctgaccgctttaagtctttggaacagcagattttagagctgaaggcagaacttgaagacagaaaagaaaggatcaaccaaaaatgacaatcacactttataatacattgactagacagaaggaaacatttgttcctcttgaagagggaaaagtgaaaatgtatgtatgcggacccacggtttacaattatattcatatcgggaacgcgcgtccggcaatcgtttacgatacggttcgaaactatttagagtataaaggctatgatgtgcagtatgtctctaacttcacagacgtagacgataaattaattaaagcggcaaatgaactcggtgaggatgtacccaccatttcagagcgttttattaaagcatactttgaagacgtgggtgcgctcggctgccgaaaagccgaccttcatccgcgagtaatggagaacatggatgccattatcgaattcgtagatcagctcgtgaaaaagggctacgcatatgaatcagaaggtgacgtatatttcaaaaccagagcgtttgaagggtacggaaagctttctcagcaatcaatcgatgaacttagatcaggtgcacgcatccgagtcggcgagaaaaaagaagatgctcttgatttcgcactgtggaaagcggcaaaagaaggagaaatctcttggatagcccttgggggaaaggacgtccgggctggcacattgagtgctcagcaatggtgaaaaagtatctcggtgaccagattgatatccatgcgggcggacaggatttaacattccctcaccatgaaaacgaaattgcgcaatctgaggcgctgacaggcaaaacgtttgcgaagtactggcttcataatggttatatcaatattgataatgaaaaaatgtcaaaatcactaggcaactttgtgcttgtgcatgacatcattaaacagcatgatcctcagcttttgagattctttatgctatctgttcattatcgccatccgattaactattcggaagagcttctggagaatacgaaaagcgcgttcaaccgtttaaaaacagcgtacagcaatcttcagcaccgtctgaacagcagtacgaatttaaccgaagatgacgatcaatggcttgaaaaagttgaagaacaccgcaaagcattcgaagaagcgatggacgatgattttaatacggcgaatgccatttcagtcttgtttgacttagcgaaacacgccaattattatcttcagaaagatcatacggctgatcatgtgattacggcgtttattgagatgtttgaccgcattgtttctgtcctcggtttttcgttgggtgagcaggaacttctcgatcaagagattgaagacttaatcgaaaagcgaaatgaagcgcgccggaatcgcgattttggattgtcagaccagatccgcgaccagctgaaaagcatgaatatcattcttgaagatacggctcaaggcactcgctggaaacggggagaataacagatgcttgaatttgatacgataaaagattctaagcaccttaacggtcttgcgcttgcttatataggtgatgccatttttgaagtgtatgtcaggcatcacctgcttaagcagggctttaccaaaccaaatgatcttcataagaaatcaagccggattgtttcagcaaagtcacaggctgagatcctattttttctgcagaatcaatcattttttacggaagaagaggaagcggtgctgaaaagaggcagaaatgccaagtcagggacaacacctaaaaatacagatgttcagacgtaccgctacagtacagcatttgaagcgcttctgggctacctttttctagagaaaaaagaggaacgacttagtcagctcgtagccgaagctatacaattcgggacgtcagggaggaaaacaaatgagtcagcaacatgattacgtcatagggaaaaatgcagtgatcgagacgttaaaatctgatcggaagctgtataagctgtggatggcggaaaacaccgtaaagggacaagcacagcaagtgattgagcttgccaaaaagcagggaatcacgattcaatacgtcccgagaaaaaaactcgatcaaatggtgacaggacagcatcagggcgtagtggcacaggttgcagcgtatgaatatgcagaactggacgatttatataaagcagccgaagaaaaaaatgaacagcctttcttcctcattctggacgagcttgaagaccctcataatcttggttccattatgaggacagcagatgcggtcggcgctcatggcatcgtcattccaaaacggagagctgtcgggctgacaacaacagtggcaaaagcttcaacaggagcaattgagcacattcctgtagcaagagtcaccaatttggcacggacgttagaagagatgaaagagcggggaatctgggttgtcggaacggatgcgtccgcgcgtgaggattaccgcaatatggacggcaatatgcctttggctctagtcatcggaagtgaaggaaaagggatgggccgtcttgtaaaggaaaagtgcgattttctcattaaactcccgatggccggaaaggtaacttcactaaatgcatctgtcgcggctggtcttttgatgtatgaagtctaccggaaacgaaaccctctgggagaataaagacccatggatatcctgttagtagacgggtacaacatgattggagcctggccgcagctgaaggatttaaaagcgaacagttttgaagaggcgagagacgtactgattcagaaaatggcggaatatcaatcgtatacaggaaacagggttattgttgtttttgacgcgcatctcgtaaaagggcttgagaaaaaacagaccaaccatagagttgaagtaatttttacaaaagaaaatgagacggctgatgagcggatagaaaagctcgctcaggctttgaataatattgcgactcaaattcacgttgcgacctctgactatactgagcagtgggcgattttcggacagggggcattgcggaaatcggcccgggagcttttgagagaggtagaaacgattgaaaggcgaatagagagacgggtaagaaaaatcacttccgaaaagccggcgggtaaaattgctttatcggaagaggttttgaaaacgtttgaaaagtggaggcggggagacttagattaagttgacgcttttttgcccaatactgtataatatttctatctacgtgcgccggggggatcggagtgaatctacagaacaacaagggaaaattcaacaaagagcagttttgccagttggaggacgagcaggtcattgaaaaggttcatgttggggacagtgatgcgttagattacttgattacgaagtaccgaaactttgttcgggcaaaagcaagatcctatttcttaataggggcggacagagaggatattgttcaggaaggcatgataggcctctataagtctattcgtgacttcaaagaggacaagcttacctcattcaaagctttcgcagaattatgtattacccgccaaattattaccgcaataaagacagctactcgccagaaacacattcctttgaattcctacgtctcattagataaaccgatttttgatgaagaatcagaccgaacactgctggatgtcatttcaggagcgaaaaccttaaatcctgaggaaatgatcattaatcaggaagaatttgatgatattgaaatgaaaatgggagaacttttaagtgatttagagagaaaagtactcgtcttatatctcgatgggagaagttaccaagagatttctgatgaactgaaccgacatgtgaaatcgatcgacaatgcccttcagcgtgtgaaacgcaagctggagaagtacttggaaattcgcgaaatcagtttgtaatagcaatttatgctatattgacagtatttttctgactatgatatgttactaaagataagaactaatgtctatttagaaaaaggtgtaatgacatgagaaaaaagattacgttagcatgcaagacatgcggaaaccgtaattatacgactatgaagagctctgcatcagcggctgagcgattagaagtaaagaaatactgcagtacttgcaattcacatacagctcatcttgaaacaaaatagtttttgcgcttttaaattgtggaggtcttttacatgcgtattatgaaattctttaaagatgttgggaaagaaatgaaaaaggtaagctggcctaaaggaaaagagttaacgcgttataccattacggtaatttcaacagttatcttttttgttatcttttttgccctccttgacacaggaatttctcaattaattcgtttaatagttgaataatgatcagcaatacgtgctataatagatcataatattacttgccaaaacccgttcagcgggttttttattgtggcttaaaatgatagttatcataggcttgccgcctattttttgaagcgttatggtaattcactaaaaccaaatgcggggagggaaggactggacagtcctgaatagaatggaaaagaattggtatgttgttcacacgtactctggttatgagaataaagtaaaagccaacttggaaaaacgtgttgaatcaatggggatgcaggataaaattttccgtgtagtcgtacccgaagaagaagaaacagatatcaaaaacggcaagaaaaaagtcgtgaaaaagaaagtattccctggttatgtgcttgttgaaattgtaatgacagacgactcttggtatgttgtccgcaacacgccgggcgttactggattcgtaggatctgccgggtcaggttcaaaaccgacgccgcttcttccgggcgaagcagaaaccattctgaagagaatgggcatggatgaacgaaaaactgatattgactttgaactgaaagagacagtgaaagtaatagacggaccttttgctaactttacaggatcaattgaagagattgattatgataaaagcaaggtcaaagttttcgttaatatgtttggccgtgaaacgccagttgagctggaatttacccaaatcgataaattgtaatgtgaaaaaacttgaaattgctatatataaatgataatatagcaaaggtacgtcttggacttatccaaggcaactagcatgatatttcgtcattcatataaagaatgaaaccttgagtgggagggtttaccctattaccacatcacggacttaaggaggtgtgtctcgtggctaaaaaagtagttaaagttgtaaaattgcaaattcctgctggaaaagctaacccagcaccaccagttggacctgcacttggtcaagccggtgttaacatcatgggattctgtaaggagtttaacgctcgtacagctgaccaagctggtttaatcattcctgttgaaatttcggtttacgaagaccgttcatttacatttattacaaaaactccacctgctgcagtattgcttaaaaaagcagctggaattgagtctggttctggtgaaccaaaccgtaataaagtggcaaccgttaagcgcgataaagtacgcgaaatcgctgaaacgaaaatgcctgacttaaacgcagcagacgttgaagcggcaatgcgcatggttgaaggtactgcccgcagtatgggtattgtaatcgaggattaatttgtttcttgtcgggttgcgagttttaacaagttcgcaacccttattcgtgggaggttattccgctataaccacataaggaggaaattttaaaatggctaaaaaaggtaaaaagtacgttgaagctgctaagcttgtagaccgttctaaagcttacgacgtctctgaagcagtagctctcgttaaaaaaacaaacacagctaaattcgacgctacagttgaagtggctttccgtttaggggttgaccctcgtaaaaacgaccagcaaatccgtggagcagttgtgcttccaaacggaactggtaaaactcagcgcgttctcgttttcgcaaaaggcgaaaaagcgaaagaagctgaagctgctggtgcagatttcgtaggcgatactgactacatcaacaaaattcaacaaggctggttcgatttcgatgttatcgtagctacacctgacatgatgggtgaagttggtaaaatcggtcgtgtacttggaccaaaaggtttaatgccaaaccctaaaactggtacagttactttcgaagttgaaaaagcgatcggcgaaatcaaagctggtaaagttgaataccgtgttgataaagctggaaacattcatgttcctatcggtaaagtttctttcgaggatgaaaaacttgttgagaacttcacaacaatgtacgatacaatccttaaagctaaacctgctgcagctaaaggcgtttacgtgaaaaacgttgctgtaacttctactatgggacctggtgtcaaagtagactcttcaacttttaacgtaaaataatattgacatgacatcaacattctgatattattcaaaatgttgtaaaatagaatatcatttataccgtagacagtaggggcctaaccgcttaattatcctaccgaggtgtatattatcacagctattacgttacgtatgcttgtatatacagcctccatgtctcatggaggctttttatatggaatccgtcgtctcagtcgtgatcacctaacggtataagtgttacacaagaatctacaggaggtgtaaccatgagcagcgcaattgaaacaaaaaaagttgttgttgaagaaattgcttctaaactgaaagaaagtaaatcaacgatcatcgttgactatcgcggacttaacgtttctgaagtaactgaacttcgtaaacagcttcgcgaagctaacgttgagttcaaagtttacaaaaatacgatgactcgccgtgcggttgaacaagctgagcttaatggtttgaatgatttcttaactggaccgaacgcgatcgcattcagcactgaagatgttgtcgctccggctaaagttcttaatgacttcgctaaaaatcacgaagctcttgaaatcaaagctggcgttatcgaaggtaaagtttctactgttgaagaagtgaaagctcttgctgaacttccatcacgcgaaggcttgctttctatgttgcttagcgtacttcaagctccagttcgcaaccttgctcttgctgcaaaagctgtggcagaacaaaaggaagaacaaggcgcttaatctaatcagtttttcataaattaaaacaaaatggaggaattacaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggagctgctgaagagcaaagcgaattcgatcttatccttgctggtgcaggatctcaaaaaatcaaagttatcaaagttgtacgtgaaatcactggtcttggcttgaaagaagctaaagagcttgttgacaacactccaaaaccacttaaagaaggtattgctaaagaagaagctgaagagcttaaagctaaacttgaagaagttggcgcttctgtagaagttaagtaatcttcacttacctgtaggggaagctcgcttttatgaggcgagctttttctttgccattctttaagccatgaaaaaaggaggttctaataatgagtgagcactattattcagaaaaaccttcagtaaaaagcaacaagcaaacctggtcttttaggcttcggaataaagatttcacgtttaccagcgacagcggggttttttctaaaaaagaagttgatttcggctcccgcctgctgattgattcttttgaagagcctgaggttgagggcggcattttagatgtaggctgcggatacggcccgattggtttatcgctcgccagcgactttaaagaccggactatccacatgattgacgttaatgagagagccgtagaactatcaaatgaaaatgcggaacaaaacggaataacaaacgttaagatttatcaaagcgatttgttttcaaacgttgattctgctcaaacatttgcttctattcttacaaatcccccaatccgagccggaaaaaaagttgtccatgctatctttgagaaaagcgctgaacacttaaaagcttcaggtgagttgtggatcgtcatacagaaaaagcagggcgcgccttctgccattgaaaagctcgaggaactgttcgatgaagtttccgtcgttcaaaaaaagaaaggctattatatcataaaagcaaaaaaagtttgactcggtattttaactatgttaatattgtaaaatgccaatgtatatattttgcttgatatgatgaattgtcaatatctatgtataaattatacaagtatggaaatgctaataaaatcggtatttgtttttggatgtggttttcttaattagaaacccttttttcttttgtcttgtaaaagtattttctttctttggaagaaatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctcttgagttcattgattatagtttaggtgagcctaaatatcctgtagaggaatcaaaagaacgtgatgtgacttactcagctccgctaagagtgaaggttcgtttaattaacaaagaaactggagaggtaaaagaccaagatgtcttcatgggtgatttccctattatgacagatacaggtacttttatcattaacggtgcggaacgcgttatcgtttcccagcttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggtcagattcttgatagaagaacacttgataaagtactgccatacttagaaaacggaatcggtttcagaaagctgtatccgaatggcggcgttgttgaagatgaagtgactcttcaatcaattaaaatctttgctccgactgatcaagaaggagaacaggttattaatgtaatcggcaatgcttacatcgaagaagagattaaaaacatcacgcctgctgatattatttcttcaatcagctacttcttcaacctgctgcacggagtaggcgacacagatgatatcgatcatcttgggaaccgccgtttacgttctgtaggcgagcttctccagaatcaattccgtatcggtttaagccgtatggagcgtgtggttcgtgagagaatgtcaattcaagatacgaatacaattacgcctcagcagctgatcaatattcgtcctgttattgcgtccattaaagagttctttggaagctcacagctttctcaattcatggatcagacgaacccgcttgctgaattaacgcacaagcgtcgtctgtcagcattaggaccgggcggattgacacgtgagcgtgccggaatggaagtgcgtgacgttcactactcccactatggccgtatgtgtccgattgaaacgcctgagggcccgaacatcggtttgatcaactcactatcatcttatgcaaaagtaaaccgttttggctttattgaaacgccatatcgccgcgttgaccctgaaacagggaaggtaacgggcagaatcgattacttaactgctgatgaagaggataactatgttgtcgctcaagcgaatgctcgtcttgatgacgaaggcgcctttattgatgacagcatcgtagctcgtttccgcggggagaacaccgttgtttccagaaatcgtgtagactacatggatgtatcgcctaagcaggttgtatctgctgcgacagcatgtatcccgttcttagaaaacgatgactccaaccgtgccctcatgggagcgaacatgcagcgtcaggctgtgcctttgatgcagccggaagcgccatttgttggaactggtatggaatacgtatcaggaaaagactctggtgccgctgttatttgtaaacaccctggtatcgttgaacgcgtagaagcgaaaaacgtttgggttcgccgttatgaagaagtagacggtcaaaaagtaaaaggaaacctggataaatacagcctgctgaaatttgtccgctctaaccaaggtacgtgctacaaccagcgtccgatcgtaagtgtcggcgatgaagtggtaaaaggagaaatccttgctgacggtccttctatggagcttggtgaacttgcacttggccgtaacgtaatggtcggcttcatgacatgggatggctacaactatgaggatgccatcatcatgagtgaacgcctagtgaaggatgatgtttatacatctatccacattgaagaatacgaatcagaagcacgtgatacgaaacttggacctgaagaaatcactcgcgatattccaaacgtcggtgaagatgcgcttcgcaaccttgatgaccgcggaatcatccgtattggggcagaagtaaaagacggagatcttcttgttggtaaagtaacgcctaaaggcgtaactgaactgactgcagaagaacgccttcttcacgccatttttggcgagaaagcccgcgaggttcgtgatacttctcttcgtgtgcctcacggcggcggcggaattatccatgacgttaaagtcttcaaccgtgaagacggagacgaacttcctccaggtgttaaccagttagtacgcgtatatatcgttcagaaacgtaagatttctgaaggggataaaatggccggtcgtcacggtaacaaaggtgttatctctaagattcttcctgaagaggatatgccttaccttcctgacggcacaccaattgatatcatgcttaacccgctgggcgtaccatcacgtatgaacatcgggcaggtattggaacttcacatgggtatggccgctcgttaccttggcattcacattgcatctcctgtatttgacggagcgcgagaagaggatgtctgggaaacacttgaagaagccggcatgtctcgtgacgccaaaacagtgctttacgacggacgtactggagagccgtttgataaccgtgtatctgtcggtatcatgtacatgatcaaactagctcacatggttgacgataaacttcatgcacgctctacaggtccttactcacttgttacgcagcagcctcttggcggtaaagcgcaatttggcggacagcgttttggtgagatggaggtttgggcacttgaagcttacggtgcggcttatactcttcaagaaattctgactgttaagtctgatgacgtggttggacgtgtgaaaacatacgaagccatcgttaaaggcgacaatgttcctgaaccaggtgttccggaatcattcaaagtattaatcaaagaacttcaaagcttaggtatggatgtcaaaatcctttctggtgatgaagaagaaatagaaatgagagatttagaagacgaagaagatgcgaaacaagctgacggcctggcattatcaggtgatgaagagccggaagaaacagcatctgcagacgttgaacgcgatgtagtaacaaaagaataatctctagttataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttaaaacctgaaaaggacggtctattctgcgaacgcattttcggaccgactaaggactgggaatgtcattgcgggaagtacaagcgagttcgttataaaggcgtagtttgtgaccgctgcggagtcgaagtaacacgggctaaagtccgtcgtgagagaatggggcacattgaactggctgccccagtttcccacatttggtatttcaaaggtattccaagccgtatgggtcttgtgctggatatgtcacctcgtgctttagaagaagtcatttactttgcttcttacgttgtaactgatccggcgaatacaccgcttgaaaagaaacagcttctgtctgagaaagaatatcgtgcttatcttgataaatacggtaataaattccaagcatctatgggtgctgaagcaattcataaacttcttcaagatatcgatcttgtcaaagaagttgatatgttaaaagaagagctgaaaacttcacaaggacaacgccgtactcgtgcgatcaaacgtcttgaagttttagaagccttccgtaactcaggaaacaagccttcttggatgatccttgatgtgcttcctgttattcctccggagcttagaccgatggttcagctagatggcggacgttttgcgacttctgatttgaatgacctttatcgtcgtgtcatcaaccgtaacaatcgtttgaaacgccttttggaccttggtgcgcctagcatcatcgttcaaaacgaaaagcgtatgcttcaagaggctgtcgatgccctaattgacaacggccgccgcggacgccctgtaacaggtcctggtaacagaccgttaaaatctctttctcacatgctgaaagggaagcaaggccgtttccgtcaaaaccttcttggtaaacgtgtcgattactccggacgttctgtaatcgttgttggtcctcatttgaaaatgtaccaatgcggattaccgaaggaaatggcgcttgaacttttcaagcctttcgttatgaaagaacttgttgaaaaaggtcttgctcacaacattaagagtgcgaaacgcaaaattgagcgcgtacagcctgaagtttgggatgtactagaatcagttattaaggagcatccggtactgctgaaccgtgcccctacacttcacagattaggtatccaggcgtttgaaccaacgcttgttgaaggacgcgcaatccgtcttcacccgctcgtatgtacagcttacaacgctgactttgacggtgaccaaatggcggttcacgtaccattatctgctgaagcacaagctgaagcacgcatcttgatgcttgctgctcaaaacatcttgaaccctaaagatggtaaaccggttgtaacaccgtctcaggatatggtactaggtaactattacctgacacttgagcgtgccggtgctgtcggtgaaggtatggtcttcaagaatacagacgaagcgcttcttgcttatcaaaacggatatgttcaccttcatacgagagtagctgttgcagctaactcacttaagaatgtgacatttaccgaagaacagcgctcaaaattgttaattacaactgtcggtaagcttgtcttcaatgaaattcttccggaatcattcccttacatgaatgaaccaacgaagagcaacattgaagagaaaacacctgaccgtttcttcttagaaaaaggtgctgacgttaaagctgttatcgcacagcagccaatcaatgcgccgtttaaaaaaggcattctgggtaaaatcatcgcggaaatctttaaacgattccatattacggaaacgtctaaaatgcttgaccgcatgaaaaacctaggcttcaaatattcaactaaagctggtattacagttggggtttctgacatcgtcgtactcgatgataaacaagaaattcttgaggaagcgcaaagcaaagttgacaacgttatgaagcagttccgccgcggtcttatcactgaagaagaacgctatgagagagtcatctctatctggagtgctgcaaaagacgttatccaaggcaaactgatgaaatcacttgatgaactcaacccgatctacatgatgagtgactctggtgcccgtggtaacgcatctaactttacgcagcttgccggaatgcgcggcctgatggccaacccggctggacgtatcattgagttgccgatcaaatcaagtttccgtgaaggtctgacagtattggagtactttatctccacacacggtgcgcgtaaaggtcttgccgataccgctcttaaaactgctgactcaggttaccttacacgccgtctcgttgacgttgcgcaggatgttatcatccgtgaaactgattgcggaactgaccgaggcattcttgctaagcctcttaaagaaggaactgaaacaattgagcgcttagaagaacgcttaatcggacgttttgcaagaaaacaagtgaagcaccctgaaacaggtgaagtgcttgtgaatgaaaacgaactgatcgatgaagataaagcactggagattgtcgaagccggcattgaagaagtgtggatccgttctgccttcacatgtaatacgcctcatggtgtatgtaaacgatgctatggccgaaatcttgcaactggctccgatgttgaagtcggtgaagctgtcggaatcattgctgcccaatcaatcggtgagcctggtacacagttaacaatgcgtacattccatacaggcggggttgctggagacgacatcacacagggtcttccgcgtatccaagagcttttcgaagcgcgtaatccgaaaggtcaggcaacaattacagaaatcgacggtacagtcgttgagatcaatgaagttcgtgacaagcaacaggaaattgtggttcaaggcgcagtggaaacacgttcttatacggcaccttacaactcccgcctgaaagtagcggaaggagataaaattactcgaggccaagtactgacagaaggttcaatcgatccgaaagaacttcttaaagtgactgacctgacaactgttcaagagtatcttctccatgaggttcaaaaggtttaccgtatgcagggtgttgaaatcggtgataaacacgtagaagtaatggttcgccagatgcttcgcaaagtacgcgtaattgatgccggtgacactgatgtgcttccaggtacattgcttgatattcaccaatttactgaagcgaacaaaaaggtattgcttgaaggcaatcgacctgctacaggccgtcctgtcttactcggtattacaaaagcatctcttgaaactgattcattcttatctgctgcttccttccaggaaacaacacgtgtccttacagatgcagcgatcaaaggtaagcgtgacgagcttctcggcttgaaagagaatgttatcatcggtaagcttgttccagctggtacaggaatgatgaaataccgtaaagtaaaaccagtatcaaatgttcagccgactgacgatatggtcccggttgaataactgatttaatgctgctgaaagactgcaaaaacagtctttcagcagatatatttatgaaaaagtcactctatgagaagaacgaaactaaaaaatgtcataccttgttgacattcgtctcctagaatgataatataaccaaggtgctcgaaattaacctgttactttggaggatatgtttatgtcttatgataaagtatcacaggccaaatcaattattattggtacgaagcaaacagtgaaagctctaaagcgaggttcagtaaaggaagtagtcgttgcaaaagacgcagatccgatactcacgtcaagtgttgtttcacttgctgaagatcaaggtatctctgtctcaatggttgaatccatgaaaaagctcggcaaagcctgcggaattgaggtaggagcagccgctgttgccattattttataacgtacttttgtttttgcgtaagattccatcttgtgtaaagacattgttttttgccttttgatgaaccacctgggtatgtgggttataaaacgtaatgaagggaggaaaaattcatgcctacaattaatcagctaattcgcaaaggacgcgtgagtaaagtagaaaactcaaagtctcctgcacttaacaaaggatacaacagctttaaaaaagagcacactaacgtatcttctccacaaaaacgcggggtatgtactcgtgttggtacaatgacaccgaaaaaaccgaactcagcacttcgtaaatatgctcgtgttcgtttgactaacggaatcgaggttactgcttacattcctggtatcggtcacaacctacaagagcacagtgttgtacttatccgcggcggacgtgtaaaagacttaccaggggtacgttaccacatcgttcgtggtgcgcttgatactgctggagttgaaaaccgtgcacaaggccgttctaaatacggtacgaaaaaacctaaagcaaaataatatacgaaaatacgcataattgatgaagggaggatattcagatgccacgtaaaggtcctgtagcaaaaagagatgttttacctgatccgatttacaactctaagcttgtatctcgtctaatcaacaaaatgatgatcgatggtaaaaaaggtaagtctcaaacaatcctatacaagtcattcgatatcattaaagaacgtactggcaatgatgcaatggaggttttcgaacaagcattgaaaaacatcatgcctgtacttgaagtaaaagcacgccgtgtaggtggtgcgaactaccaagttcctgtagaagttcgtcctgaacgtcgtacgactcttggacttcgctggttagttaactacgctcgtcttcgcggagaaaaaacgatggaagagcgtttagctaacgaaatccttgacgcagctaacaacactggtgctgctgttaagaaacgtgaagacactcataagatggctgaagcaaacaaagcatttgctcactatcgctggtaggatttatagattaacaaaacacaatttcctaataaggaaggagaaattacccaatggcaagagagttctccttagaaaaaactcgtaatatcggtatcatggctcacatcgatgccggtaaaacgacaactacagaacgtatcttgttctatactggtcgtatccacaaaattggtgaaactcatgaaggagcttcacaaatggactggatggagcaggaacaagaacgtggtatcacaatcacttccgctgcaacaactgcacagtggaaaggatatcgcgtaaacatcatcgatactccaggacacgtagacttcacagttgaagttgaacgttctcttcgtgtacttgatggtgctgttgctgtacttgacgcgcaatcaggcgttgagcctcaaacagaaactgtttggcgtcaggcaacaacttatggagtaccgcgtatcgtttttgttaacaaaatggacaaaatcggtgcagacttcctttactctgtaggaactttaagagaccgtcttcaagcaaacgctcatgcaattcaattgccgatcggtgctgaagataacttcgaaggtatcatcgaccttgtagaaaacgttgcgtatttctacgaagatgacctcggaactcgttctgatgcaaaagaaatccctgaagagtacaaagagcaagctgaagagcttcgcaacagccttattgaagctgtatgtgagcttgatgaagagcttatggataagtaccttgagggtgaagaaattacaattgacgagttaaaagcaggaattcgtaaaggtacattaaatgttgaattctaccctgttcttgttggttctgctttcaaaaacaaaggtgttcaactagtacttgatgctgttcttgactaccttcctgcaccaactgacgttgctgcaatcaaaggtacacgtcctgatacaaatgaagagattgagcgtcattcttctgacgaagagccattctctgcattagcatttaaagttatgactgacccttacgttggtaagttgacgttcttccgtgtgtactctggaacacttgattctggttcatacgtgaaaaactctactaaaggcaaacgtgagcgtgttggacgtattcttcaaatgcacgctaacagccgtgaagaaatctctactgtatacgcaggggatatcgcagctgctgtaggtctaaaagatacaactactggagatactctatgtgatgagaaggatcttgttatccttgagtcaatggaattcccagaaccagttatcgacgttgctattgagcctaaatcaaaagctgaccaagataaaatgggtatcgctttagcgaaacttgctgaagaagatcctacattccgtactcaaacaaacccagaaactggccaaacgatcatctctggtatgggtgaacttcaccttgatatcattgttgaccgtatgaaacgcgaatttaaagtagaagccaacgttggtgctcctcaagttgcgtaccgtgaaacattccgtaccggtgcaaaagttgaaggtaaattcgtacgtcagtctggtggacgcggtcagttcggacacgtttggatcgaattcgaaccaaacgaagaaggcgctggctttgaatttgaaaatgcgattgtcggtggggtcgttcctcgtgaatatatcccagctgttcaagcaggtctggaagatgcacttgaaaatggtgtactagcaggcttcccgcttatcgacattaaagctaaacttttcgacggttcttaccatgatgttgactcaaacgaaatggcatttaaagttgctgcttctatggcattgaaaaatgcagtcagcaaatgtaacccagttcttcttgaaccaatcatgaaagtagaagtggttattccagaagaatacatgggagatatcatgggtgatatcacttcacgtcgcggacgcgtagaaggtatggaagcacgcggtaacgctcaagttgttcgcgctatggttcctcttgctgaaatgttcggttacgctactgcacttcgttctaatacgcaaggtcgcggtacgttcactatgcacatggatcactacgaagaagtgccgaagagcgtcgcagaagaaattatcaaaaaaaataaaggcgaataattgattttgcctcttaactcaagtataactactattgtaagatgaggaagtgaaagctttctttcacttcctatcactctatacattactaattaaaagctcttaaggaggattttagaatggctaaagaaaaattcgaccgttccaaatcacatgccaatattggtacaattggacacgttgaccatggtaaaacaactttaactgctgctatcacaacagtacttcataagaaatctggtaaaggtacagctatggcgtacgatcaaattgatggtgctccagaagaacgtgagcgcggtatcacaatctctactgcacacgttgagtacgaaactgaaactcgtcactatgcacacgttgactgcccaggacacgctgactatgttaaaaacatgatcactggtgctgcgcaaatggacggagctatccttgtagtatctgctgctgatggcccaatgccacaaactcgtgagcacatccttctttctaaaaacgttggtgtaccatacatcgttgtattcttaaacaaatgcgacatggtagacgacgaagagcttcttgaactagttgaaatggaagttcgcgatcttcttagcgaatacgacttccctggtgatgatgtaccagtaatcaaaggctctgctcttaaagctcttgaaggtgacgctgagtacgaagcgaaaatcttcgaacttatggatgcggttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagatgagaacaagaaaacaactgttacaggtgttgaaatgttccgtaagcttcttgattacgctgaagctggtgacaacattggtgcccttcttcgcggtgtatctcgtgaagaaatccaacgtggtcaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatccatcttccagaaggcgtagaaatggttatgcctggagataacactgaaatgaacgttgaacttatttctacaatcgctatcgaagaaggaactcgtttctctattcgtgaaggcggacgtactgttggttcaggcgttgtttctacaatcactgagtaatagtatgattttaaacgagacccctgcgggtctcgttttttgtttgcttatctttttcttgtataataggatctatcatattcgagggttaatatttatgattcctgaaaagaaatcaatcgcaatcatgaaagaactaagcattggaaatacaaagcaaatgctgatgattaatggagttgacgtgaaaaaaccattgctgctttttttacatggcgggccgggaacgtcgcaaatcggatatgttagacattatcaaaaagagctggaacagtattttacagtagttcattgggatcagagaggatcggggctttcttattctaagcgaatttcgcatcactctatgacaataaatctcttcattaaagatacaatccaagtcactcaatggcttttagctcatttttcaaaatcaaaactttacctagccggtcattcttggggatcaatagtggcgcttcatgtgctgcagcagcgtcctgatttattttacacgtattatggaatcagccaggttgttaacccgcaagatgaagaatcaactgcttatcaacatattcgtgaaatttccgaatcaaaaaaagccagcatattatctttcctcacacgtttcattggtgctccgccttggaagcaggatatccagcaccttatctatcggttttgtgttgagctgagcaggggaggattcactcaccgtcatcgtcaatctctagctgtattatttcaaatgcttactggcaatgagtatggagtacggaacatgcacagcttcctcaatggattgcgcttcagtaaaaaacatttaactgatgagttgtaccggtttaatgcttttacatcagttccttctattaaagtaccgtgtgttttcatttcagggaaacatgacttaattgttcctgcagaaatatcgaaacagtattatcaagaacttgaggcacctgaaaagcgctggtttcaatttgagaattcagctcacaccccgcatattgaggagccatcattattcgcgaacacattaagtcggcatgcacgacaccatttatgatagatccttgataaataagaaaaacccctgtataataaaaaaagtgtgcaaaccatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagaactgtctaacgtgatgtaggcgaaaaggagggaaaataatggcaaaacaaaaaattcgtattcgtttgaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctcttatgcgattagacttaccatctggtgtcgatatcgaaattaaactttaattctaaaatatagaatgatcttaataggaggtgtgacgaatgaccaaaggaatcttaggaagaaaaattggtatgacgcaagtattcgctgagaatggtgatcttattccggtaactgttatcgaggctgctccaaacgttgttcttcaaaagaaaacagctgaaaacgacggttacgaagcaatccagcttggttttgacgacaagcgtgaaaagctttctaacaaacctgaaaaagggcacgttgcaaaagcggaaactgctcctaagcgcttcgttaaagaattacgcggagtggaaatggatgcgtatgaagttggtcaggaagtcaaggttgaaattttctctgctggagaaatcgtagatgtaacaggagtatctaaaggtaaaggtttccaaggtgcgatcaagcgccacggacaatctcgcggacctatgtctcacggttcacgctaccaccgtcgtcctggttcaatgggacctgtagatcctaaccgtgtattcaaaggtaaattattacctggacgtatgggcggagagcaaatcactgttcaaaaccttgaaatcgtaaaagttgatgcagaacgcaatcttcttttgatcaaaggtaacgtacctggtgcgaagaaatctttaatcactgttaaaagtgctgttaaatctaaataattctcttaggaaaggaggaaattgattatgccaaaagtagcattatacaaccaaaacggttctactgctggtgacatcgaattaaacgcttctgtatttggtatcgaaccaaatgagagtgttgtattcgacgctattcttatgcaaagagcttccttacgtcaaggaactcacaaagtaaaaaatcgttctgaagtacgcggcggaggtcgtaaaccatggcgtcaaaaaggtactggacgtgcccgtcaaggttcaatccgttcaccgcaatggcgcggaggtggtgtcgtattcggcccaacaccacgcagctattcttataaattacctaaaaaagttcgccgcttggcaatcaaatcagtattgtcttctaaagtgatcgacaacaacatcatcgttcttgaagatcttactcttgatacggctaaaacaaaagaaatggcagctatccttaaaggattatctgttgagaaaaaagctttaatcgtaactgcggatgcaaacgaagcagtagcattatctgctcgtaacattcctggagttactgttgttgaagctaacggaatcaacgttttagacgttgtcaaccacgagaagcttctgattacaaaagcagcggttgaaaaagtagaggaggtgcttgcataatgaaagatcctcgtgatgttctaaagcgccccgtcattactgaacgttctgctgatttaatgactgaaaaaaaatatacttttgaagttgatgtaagagctaacaaaacagaagtgaaagacgcggttgaaagcatctttggagtgaaagttgataaagtcaacatcatgaactacaaaggcaaatcaaaacgtgtcggacgctacactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaatggacgtcgtggcatgacaacttcagattttgctgaaatcacgactgacaagccggaaaaatccttgcttgctccccttcacaaaaaaggcggacgtaacaaccaaggtaaattgactgtacgtcaccaaggtggcggacataaacgccaataccgtgttatcgacttcaaacgcgataaagatggtatacctggacgcgttgctacagttgaatacgatccaaaccgttcagctaacatcgctctaatcaactatgcagacggagaaaaacgttacattcttgctcctaaaggaattcaagtaggtactgaaatcatgtcaggtcctgaagctgacattaaagtaggtaatgcacttccacttatcaacatccctgttggtacagttgtgcataacattgaattaaaacctggtaaaggcggacagcttgtacgttcggctggtacatctgctcaggttcttggtaaagaaggtaaatacgttcttgtacgtcttaactctggtgaagttcgcatgatcctttctgcttgccgtgcttctatcggtcaagtaggtaacgaacagcacgaacttatcaacattggtaaagctggacgttctcgctggaaaggcatccgtcctacagttcgtggttctgtaatgaaccctaacgatcacccacacggtggtggtgaaggacgtgcgccaatcggacgtaaatcaccaatgtctccatggggcaaaccaactcttggattcaagactcgtaagaaaaagaacaaatccgataaatttatcgtacgtcgtcgtaaaaataaataacggggttgtctacggttcttttcggaccgtagtgcaatcacgaagggaggttccaaaatggctcgcagcttaaaaaaaggaccatttgtcgatggacacttgatgactaaaatcgagaaattaaatgaaacagacaagaaacaagtcgtaaaaacttggtctcgtcgttctactattttcccacagtttattggtcacacaatcgcagtctatgacggacgtaaacacgtgcctgtattcatctctgaagatatggtagggcacaagttgggtgaattcgctccaactcgtacgtacaaaggtcatgctagtgatgacaaaaaaacaagacgctaagagaggaggcttttaaatgcaagctaaagctgttgcaagaacagtccgtattgctcctcgtaaagcacgtctagtaatggacctgattcgaggcaagcaagtaggtgaggcagtatcaatcttgaaccttacaccaagagctgcttctccaattatcgagaaagtattaaaatccgctattgcaaatgctgagcataactatgaaatggacgctaacaacctggttatttctcaagcattcgttgacgaaggccctacgttaaaaagatttcgcccacgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaatacattagcaaacgcctttctgacgcttctgtttctaaagtagaaattgagcgtgcagcaaaccgcgttaacattacgatccacacagctaagcctggtatggttatcggtaaaggcggttctgaagtcgaagcacttcgcaaagcccttaacagccttactggcaagcgtgtacacattaacattcttgaaatcaaaagagcagatcttgatgcacagctagttgctgacaacatcgctcgtcaattagaaaaccgtgtttctttccgccgtgcgcagaaacaacaaatccaacgtactatgcgtgctggagcacaaggtgtgaaaacaatggtttctggtcgtcttggcggtgcagatatcgctcgttctgaatactacagtgaaggaactgttccattgcacacattgcgtgcggacattgactatgcaacatctgaagctgatactacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgtggccgtgcgaaaggcggtactgaagtacatttcggagaattcggtatccaagctcttgaagcttcttggattactaaccgtcaaatcgaagctgcacgtattgcgatgactcgttacatgaaacgtggcggtaaagtttggatcaaaattttcccttctaaaccttacactgctaaaccacttgaggtacgtatgggatccggtaaaggggctccagaaggttgggtagctgttgtaaaaccgggcaaagttttatttgaaatttctggtgtgtctgaagaggttgctcgtgaagcgcttcgccttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgctaataaataatcactgaggggaggtcgtgagcatgagcgaacgtaaccaacgcaaagtttaccaaggccgtgttgtttctgacaaaatggataaaaccattactgttgttgttgagacatacaaaaaacatacactttacggtaaacgcgtaaaatactcaaaaaaattcaaagcacatgatgaaaataatcaagctaaaatcggtgacatcgttaagattatggaaactcgtcctttgtctgcaactaagcgtttccgtctagttgaagttgtcgaagaagctgttattatctaataaagttcggaattctttttccgaagggaggtaacaaataatgattcaacaagagactcgtttaaaagtagctgacaactctggcgcacgtgaagtacttactattaaagttcttggtggttctggacgtaaaacagctaacattggtgatgtaattgtttgcacggttaaacaagcaacaccaggaggcgttgtcaaaaaaggtgaagtcgtaaaagctgttatcgttcgcactaaaagcggagcgcgcagaagtgacggttcatacatcagcttcgatgagaatgcatgtgttatcatccgtgacgacaagagcccacgcggaactcgtatcttcggaccagttgctcgtgaattgcgtgaaaacaactttatgaaaattgtttctctagctccagaagttatctaatgaaataaatgccttactcaaggaggtgcgatcaggatgcatgtaaaaaaaggcgataaagttatggttatctctggtaaagataaaggcaaacaaggaacaatccttgctgctttccctaaaaaggaccgcgttttagttgaaggtgttaacatggtaaagaaacactctaaaccaactcaagctaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgtagcaaaaaaatctgggcaagttctagataaatagtattaaaaggaagggaggtctatctcatgaaccgccttaaagaaaagtacaataaagaaattgcacctgctttaatgactaagttcaactacgattcagtcatgcaagtgcctaaaatcgaaaaaatcgtaatcaacatgggtgttggtgacgctgttcaaaacgccaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcggggtttctaaaaaatctttcgacggtcgcggtaactacacacttggtatcaaagaacagttaatcttccctgaaattgactacgataaagtaacaaaggttcgcggaatggacatcgttatcgtaacaacagctaatactgacgaagaagctcgtgagctattaactcaagtaggtatgccgttccagaaataatcaatgaaagggaggcgaaatcgtggctaaaaagtctatgattgcgaaacaacaacgtacaccaaagtttaaagtacaagagtacacacgctgtgaacgctgcggacgtccgcattcagtcattcgtaaatttaaactttgccgtatttgtttccgtgagcttgcatataaaggacaaattcctggcgtgaaaaaagccagctggtaatccccaagaaagggaaggaggtaattatataatggttatgacagatccaattgcagatatgctaactcgtattcgcaatgcaaacatggtacgtcatgagaagcttgaaattcctgcttctaaattgaaaagagaaattgctgaaattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaagcctggtttgcgtgtttatgctaaatctaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacatgaatggaggtgtttggtatgtctcgtgtaggtaagaagctacttgagattccttctgatgttacagtaacgttaaatgataacaacactgtagctgtgaaaggaccaaaaggagaattaactcgtacgtttcaccctgatatggagattaaagtagaggacaatgtgcttacagttgctcgtccttctgatcaaaaagagcaccgtgccctgcatggtacgactcgcagtctgcttggcaacatggttgaaggtgtatctaaaggatttgaaagaggtttggaattagtcggtgtcggttaccgtgcttctaaatccggaaataaacttgttttaaacgttggatactctcatcctgttgagatcgttcctgaagaaggcatcgaaatcgaagttccttctcaaacaaaagtagttgtaaaaggtacagacaaagaacgcgtaggagctattgctgctaacatccgcgctgtacgttctccagagccttacaaaggtaaaggaatccgctacgaaggtgaagttgttcgccgtaaagaaggtaaatctgctaagtaagatcgcttaaagtgaagaaaggagtgacctagatgattacgaaaactagcaaaaatgctgctcgtcttaaaagacacgctcgtgttcgcgctaaactttccggtactgctgaaagaccgcgcctgaacgttttccgttctaacaagcacatttacgctcaaatcatcgatgatgtaaatggtgtaacacttgctagtgcatctactctcgataaagacttgaacgttgaaagcactggagatacttctgctgctactaaagttggagaattagttgcaaaacgcgctgctgaaaaaggcatttctgacgtagtatttgaccgtggcggatacttataccatggacgtgtaaaagctttggctgatgccgctcgtgaagctggacttaaattttaataaaagaaggagggacacatgattatgcgtcgtattgacccaagcaaattagagttagaagaacgcttagttacggttaaccgcgtagcgaaagttgttaaaggtggtcgtcgtttccgcttcgcagctctagtcgttgtcggtgacaaaaacggacacgtaggattcggtactggtaaagcacaagaagtaccagaagcgatccgcaaagctgttgaagatgcgaaaaagaatttgattgaagtaccaatggttggaactacaattccacacgaaatcatcggacgtttcggtgcaggtaacatcttgttaaaacctgcttctgaaggtactggagttatcgctggaggccctgtacgtgcggtacttgagctagctggtgtagctgatatcctttctaagtctttaggttctaacacaccgatcaacatgattcgtgcaacacttcaaggtttaagtgaacttaaacgtgctgaagacgttgcgaagcttcgtggaaaatctgtagaagaactgttaggataaggagggaacattaatggctaaattagaaattaccctcaaacgaagtgtaatcggtcgcccggaagaccaacgcgttactgtaagaacacttggtttaaagaaaacaaaccaaactgttgttcatgaagacaacgctgcgatccgtggtatgattaataaagtatctcatttagtttctgttaaagaacaataaaaatatttgatcggataaggaggtgtcctaatgaaacttcatgaattaaaaccttcagaaggttcacgcaaaacgcgtaatcgcgtaggtcgtggtattggttctggcaacggtaaaacagctggtaaaggtcacaaaggtcaaaacgctcgttctggcggcggtgtacgccctggattcgagggggacaaatgcctttattccaacgtcttcctaaacgcggtttcactaacatcaaccgcaaggaatacgctgtagtcaacctagacaaattgaacggttttgcagaaggaacggaagtcactcctgaacttcttctagagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaaaacaatctccaactttatgcgtgtgagtgatatcaggaataaaatcatattcactttactcatgcttatcgtctttcgcataggtgcgtttattcctgtgccttacgttaacgctgaagcgttacagacgcagtctcaaatgggtgtttttgatctccttaatacatttggcggcggtgcgctttaccaattttccattttcgcaatgggaattactccttatatcacggcttcgatcatcattcagctgcttcagatggatgttgtaccgaagtttaccgagtggtctaagcaaggtgaagttggccgccgtaaattagctcagttcacaaggtactttacgattgtgcttggtttcatccaagcattaggtatgtcatatggatttaacaatctggcaaacggtatgctgatcgaaaaatccggtgtatcgacatatattatcattgctttagtactcactggcggaactgcctttttaatgtggcttggggaacaaattacttctcatggagtaggcaacggaatatcgatcattatcttcgcggggattgtgtctagtattccaaaaacaattgggcaaatatatgagactcaatttgtcggtagcaacgatcagttgtttattcatattgtgaaaatcgcacttcttgtgattgcgattttagcagttattgttggagttattttcattcagcaagccgtacggaaaattgcgattcaatatgctaaaggcac
